United States Patent 6,737,248 (STAPHYLOCOCCUS AUREUS POLYNUCLEOTIDES AND SEQUENCES) - sequence listing, part 2

SEQ ID NO: 1108 - DNA, 506 bp; double-stranded, linear
tcacagtggcggcacaaaaagtaagtggagattattttaatttaattgaccataacgatggcacaatgagctttgctgttgcagatgtcattggaaaaggtataccagctgctttagcaatgagtatgataaagtttggcatggattcttatggacactcacaattaccgagtgatggtttaaaacgtttaaatcgtgttgttgaaaagaatattaatcaaaatatgttcgtcacaatgttttatggtttatatgaagaaatgaaccatttattgtattgtagttcagctggtcatgagcctggatatatttatcgcgctgaaaaagaagaatttgaagaaatttcagttagaggtagagtgttaggaatcagttcacaaacacgatatcaacaacaagaaattccaatataccttgatgatttaattatcattttaacggatggtgtgactgaagctagaaaagtgaaggtacctttatagataaacaaaaacttttagaatata

SEQ ID NO: 1109 - DNA, 552 bp; double-stranded, linear
tgatattgaaaaagatgtcattgttaaagcacaagaaagtaaaattgctcaagttatcacgaatttgttaacgaatgcaattaactattcttatgaagatggagatattaacgttcgtgtgtatcgagatgactttcgtgtcattttcgaagtacaagattttggtataggtattaaattagaagaccaacaacgtatttttgaaagattttatagagtagataaagcacgaagtagnagattctggtgggacaggtcttggattatcaattacaaagcatatagtagasgcccaccaaggcaatattgaagtgaatagtcaagttggcaaaggctcaacgttcaaagttattctaaaagattataaagaataanaattaaagtggtaacagcgcgtgtatttttcacgaagttgttgctgcttttttatttcgttcaaatctctattggtattaaattagagttaatgaagtggaataaattcggttgtcaattttgtcatttgtatatgtcgatttgtaagttataagtaatagattgttgtgaatcang

SEQ ID NO: 1110 - DNA, 244 bp; double-stranded, linear
aacagatcaacaattgcagatcaattactcgtcatattgatcaattatctctgacaacgagtgatgatttattacgtcattgattgatcatcacaagataagtcgctattgatttctcaattttacaacganattaggaaagctgnagcagataattggctaagttggacgataaaggttatcaatcgccaatcgttgccattgaagaacttttgctcactggcgcacgcttcagatgatattt

SEQ ID NO: 1111 - DNA, 825 bp; double-stranded, linear
agtattgagtgttttgatttaagagacttggaaagtgagtcaataatcaaaatcttactcaatacttttattttggtactcgcaatttagatttgttaactaattttttcgcttattataaaacgaaacaatcaagtaaacgataaagcctacaaagatacccaataaaatagatagtactgccgtcactattaatggtaatttgaaaaatatttgtaggaaaatmccaatgataattgcgataattactgcaattaatgtgactgtattttcatttgaaatgttcatttattttcactccttaacaataacattatatcatgctatagctttccaaaatattgaaatatgtagatatggctattgacgatatttcttaacttttatatgattaatcggaatgaaaaaagagaagtaggtggcaatatgaagtcaaataaatcgcttgctatgattgtggtagccatcattattgtaggtgtattagcatttcaatttatgaatcatacgggtcctttcaaaaaggggacgaatcatgaaactgtacaagatttaaatggtaaagataaagtacatgttcaaagagttgtggatggtgatacatttattgcaaatcaaaatggtaaagaaattaaagttaggcttataggggttgatacgccagaaacggtgaaaccgaatacgcctgtacaaccatttggcaaagaagcatcaaattatagtaagaagacattaacaaatcaagatgtttatttagaatatgataaagaaaaccaantcgctatggtagaccattggcgtatgtatggataagtaaagatcgta

SEQ ID NO: 1112 - DNA, 621 bp; double-stranded, linear
tccctataaatccccacaaaaaaagggtaaatccgaacgtcaaatttcatctctttatgccaatcaacgatcgatttaccttttaaaatttaaaatgtatctgtaatactcttagcaatatttgtatatgctgcatcttccataggtggattgtgtaatcctgcacgcatgtcacgatagtaacgttgtaatggtcgattcatttctaagcttttagcaccaactattctcatcgctaaatcaatcacttcaagcccttgattcattaccatcactttactcgcacttgttggatttcttatctgactgtcatctttatattgttgatacccttttgctgtactccataaaaattgtctcgcacataacaatagcgtttccattttccctaaattttgttgcacagttggcaatgttgcaatcgttccttcaatactattagggctatgttggattgcaaagtctacagcataatttctagcagcttgtgctatacctaaataacagcttggtatatgcaatatccaaccatttggcgctttacttttctctgtttccactaaatgttttaatggtacttttacatcatttaatattaaatcatgactttctgtcgctcgc

SEQ ID NO: 1113 - DNA, 619 bp; double-stranded, linear
gtaccttgtttttcagtgttaatttcccaaatataacctggtgtaataccgtattgttttgagaagtacttgaaggcaccttcacttgtaatcatggcacgttgttcttctggaatgtcattaaatttgtctttactgtctttactgtcattatttaatttttccaattgagcaatgtatttgttaccttgcttttcataatctgctttatgttttttgtcgttatcgataaatgtttgttgaattgtttttacgtatttaataccgttatctaaacttaaccatgcgtgtggatcttgtttatctttgttgccttcttcaccgtttaaatagataggtttaacatcttttgatactgcgataacttttttatcttttaatgatttaccagcctgttctaaggctttttcaaaccaaccgttaccagtctcyaaatttaatccgtkgtataaaataacgtcagcgkcagttaactttttaatatcyttaggtttaacytcatawtcatgaggatctkgaccaacaggtacaatacnatgaatatcgacgttgtctccaccaacatttttagccatatcagatagaattgaattcgtcgntactactttnaatttgccat

SEQ ID NO: 1114 - DNA, 549 bp; double-stranded, linear
gaaaaccgcacgacaatgaaaaaagatatccggttaaaatggtcgataataaaatcattccaacaaaagaaattaaagatgaaaaaataaaaaaagaaatcgaaaactttaagttctttgttcaatatggtgactttaaaaatttgaaaaattataaagacggagatatttcatataatccagaggtgccgagttattcggctaaatatcaattaactaatgatgattataatgtaaaacaattacgcaaaagatatgatataccgacgagtaaagctccaaagttattgttaaaaggttcagggaatttaaaaggctcatcagttggatataaagatattgaatttacgtttgtagagaaaaaagaggaaaatatatactttagtgatagcttagattataaaaaaagcggagatgtataatcatggctcaatcagaatatgaaatcaatcccggaaaaagagagtgatgaaatgataaaacgtgtaaataaattagtgcttggtattagtcttctgtttttagtcattagtatgcactgctggttgt

SEQ ID NO: 1115 - DNA, 317 bp; double-stranded, linear
tgttattgcaactattaaaaatatnaaaaacaaagacttaattgattattctttatatattaaaaaaggtttagtggagccatttattgtattctataatcaagaaaatatattctacattagcaatgctgttatagatatcatcagtgtatccaaagatactcttgattatataaagtcagaattcaatgatcactgtgttcgccatactgattttatagcacagagaaaagccgtagtttcgaagagaccaacggcttttttataaatccttagattgtcaaattaagcgggacaagtttatcatcttcgatgaa

SEQ ID NO: 1116 - DNA, 400 bp; double-stranded, linear
actatgactgcaatgccaacaatgaatgttattgcataaagcatatgcatttaatcaagcttatgttatttagcaagggcaagccacttctcgattcatggcttgccttattttattgtatatttttaattatcgttgctgggcccttgattgacaatcgtattaaaatggccttattaagtcaactttgtctatacggtttggaatcttctacccaatgtcttataaaagacaatcccgcacctgaaacataactcatgaanataagaanatggtataccattaatntgaatccatttccantttataacgttgtaaatgacacataattagaatcataaagtttttcgtgggatattgaaactttacccatacgagacatcatggataaaagcgaggc

SEQ ID NO: 1117 - DNA, 696 bp; double-stranded, linear
tgcatataatgttcaaacggcaatgattccactgtataaacctcttgtcgtggatgatctttaatttgttgttttaataactgaactcttttttcatgttcataatgaacataaataaatgcactaagatatatcacagctaaaactagtgatgcacctttaataaaattaacattgattgacttatatttccgaaattcttttaataaaataattaaaatgattacatgtatcgtataaacaatcaaaaaattacctggttctattggagtaacaatgactagtgtcgacgccgaaacacatattgcaataagtaaggaatataaagtgatttgtgttttacgatcattaatagacaaataaatacctacaaatatcgaaaacgcaaagtaaccacatacaattacgttcacaaaaccaaccaatccaatatctgtatttttatttaataaaaactgattgtaaaatagtaaataataaagcggtaaagtgataaatcctatcataatgatacgacgctttaatattgttaaatgtacataccgatcacttctaagcagtagataaataataagcgctgcaatcatacttaaaattataatctgactgaaaatgacaccatatggaagtgacgttgatatcatttctgcaaattttgaaaagataccttgattatttgaaacttgttgatattct

SEQ ID NO: 1118 - DNA, 223 bp; double-stranded, linear
gcagtgacaatcaataatttgtaactagaagataataaagagaacgctctatagagacgaattgaaggtttgattttaatgtctgttagtaagaatcatatcaatgagatgcctatagtactcagantatattaaattaaaaccgtcattaattgtttttccgaaaaccatttgtaaccatttnaatgtagttggacctacctacgttctccaataatccatt

SEQ ID NO: 1119 - DNA, 265 bp; double-stranded, linear
ctgctttaccttttccaactttagaaattgctacataggggccttctgctttaccgccccaattccaattccacattttcaagaaataaggaggcaaaaatgttcatatatgaattggaattatttgttttcttattaggccgagatgcgccgcgtgcggctgctggagatggcggacgcgatggatatgttctgccaagggttggtttgcgcattcacagttctccgcaagaattgattggctccaattcttggagtggtgaat

SEQ ID NO: 1120 - DNA, 329 bp; double-stranded, linear
taataaatcaatcacnatcactttgtgttaaaatatgtgtcaaaggaagtgagggtttgtcatgacattacatgcttatttaggtagagcgggaacaggtaagtctacgaaaatgttgaccgaaataaaacaaaaaatgaaagcagatccgcttggagatccaatcattttaattgcgcaactcaaagtacatttcaattagaacaagcctttgtcaatgatccggaattaaatggtagtttaagaacagaagtgttgcattttgaacgattaagtcatcgtattttccaagaagttggtagttatagcgaacaaaagtnatctaaagc

SEQ ID NO: 1121 - DNA, 252 bp; double-stranded, linear
acacctcttttttaatatatgtgaactatatatagtgtatagagaggttacttgttactcaatataaacaaaaatcaactttgtcaaaataaatgtgacaaaattaaataaagtgtcatcaatgtgacagtatagatcattttgcaaaaagtcaaaacaaaaaaattgttttagggatttttcaaaattttcattgtggaaaatgatttgncaaaacaaaacaacacnttgtgagcaatgaagcttcaatgg

SEQ ID NO: 1122 - DNA, 400 bp; double-stranded, linear
naataataggcgccacctaataaaccagctggaatgcctatcattggtgttgtgaatgagcttaatacaataacaagtattgttaaagcaatgacgttataccaagttacagtcaaatttttcaaatcctcatatgattgttttactaattctctaaatttcatgattcaatctctccttttcttaaatcaattaatagttatactgcattgcttaaaatcaanatatctaatgaagcatcttttaatcgtaagtgttaaatggttttcttaatcaatttgtttgaatgtataanagcaattaaagcaaaagtaatgtaaatgagggtgtatacaacaattactacaataaccggcatgaaggaaatattacccatcaatttcataaatgcgattgcggc

SEQ ID NO: 1123 - DNA, 270 bp; double-stranded, linear
aatacaaccttttatcatagtgtaaatgtattctaccagtattgagaagttttcatattattcaatacctgaaatcgccatagtaatattactaaatgcacactgcatatgttgtttaacaacacaactttaaaaatatattctaactctatctacgaatgtacttaaatatcataacaatctattccaaatcnaattacattattagctaccttaaaaaccaaaccgaggccttaggcctcggtttaaatatatataacgngcgacatg

SEQ ID NO: 1124 - DNA, 400 bp; double-stranded, linear
ggtcttctgtatcaaattatattatgagagttagactcagtattaatgaaatcgttgataaagatcaagtgcttgcatcacaaataggtggattactatgatgtttaatcaaattaataataaaaatgaattagaagaatcatatgaatctgagaaaaaacgtatagagaatgaactgcaaaatttaaatgaacttaggcatagaactcgaaaagaaaatgaacgtagttatgatgtttttcaatatttgaagcacgaaatgaattatagtgaagatgcccaaaggaaaatgacgagaaatatagaagcgtatgagcaagaaatcaatgagataattagaaagcaagaatggaaattaggaagaatataaagaagacttaaaaaagtcttatgaaaagca

SEQ ID NO: 1125 - DNA, 377 bp; double-stranded, linear
tttttaatggaaaaagatgtatctttattgttgtttaaataaatagcactttgttcatttaaatataytcgatcattgataatatgtgctttactattccaaataactttcaaattttgataatattcatcaatactctcaatataactaaccagtttatacaaccattcgccatcgactttcacatatttttgaatactatttccaaytttaagacgtgttggttcatttacaaaatgccccaaattaataccacttaataatccaaatggagttggacgtgttgacattctaattaaatattttaataaactttctttagcatctctaaccttcttgttatcgccatcaaaatttattncntgtaaagtacaata

SEQ ID NO: 1126 - DNA, 227 bp; double-stranded, linear
gttacattactgttcatgtccacaacgtttgtcagcgattatcatcattgtgttatatcttatttatagcaagtgcatggtctggataagtaaaggtattcatacttaagtaacttgaacattggtttaggactattttaatggtnctgcttnaattgttggccaactggttcttattttaaatatgtaactagctctacgggtagttactaaacacatcctggttt

SEQ ID NO: 1127 - DNA, 717 bp; double-stranded, linear
ccaatgataccgttatagcatgttaatgtttttgtacgaatataatctaaaacttcgagttcatcacttaatttccacgtttctgctttgtttaaccacattaaaggagtatgaatgncaaaatctttgtccatagctaggcttaatgttacgttcattgattttataaaactatcgcgacagtctgggtagcctgaaaagtctgtttcacatacgcctgtaataatatgcttagccccaatttgataagctagagcgcctgcaaacgacaagaaaagtaaatttctagctggaacaaatgtattaggtataccatcttcattattagtaatttccatatcatgttgtgttaatgcgtttggagtaagttgtgataataatgacatatctaaaacgtgatgtttcattccttgatcttgtgcaatttgttttgcgacttcaatttcagtatcatgtctttggccataattaaacgttacgagttcaacttctttgaaatgtttttttgcataaaagagacatgttgtactgtcttgaccaccactaaagacaacgatggctttttcattatttaatacactttccattttgtaattgctcctatcattaataatattaataaagaggttaatggcattgataagcccgtttttaatttataaaataaaaaaagccnatctccataaaagatagacganagaaatgggttgctcctat

SEQ ID NO: 1128 - DNA, 595 bp; double-stranded, linear
gattattgcattgacaacttatatctatctaacgttagtagcatttaatttcatttccggggttctaactttaccaggattagcggcgttggtattaggtgtaggtatggctgtagatgccaatattatcatgtatgagcgtattaaggatgaacttcgaataggtagaacgataaagcaagccttttctaaagcaaacaaaagttcattcctaacaatttttgattctaacttaacaacagttatcgccgcagcagtattattcttcttcggtgaaagttcagttaaaggtttcgcgacaatgttattattaggtattctaatgatctttgttacagccgtgttcttatcaagattcttattatcattacttgtttcatcaaatatattcaaaaatcaattttggttatntggtgttaaaaagaataaacgacatgatattaatgaaggtgtagatgttcatgaccttaaaacttcattcgagaaatggaattttgttaaattagctaagccattaattggagtaagtattttaattgtagtgtcggttagttattcnttatatctcaagtaaacttaggantgantctcaagt

SEQ ID NO: 1129 - DNA, 371 bp; double-stranded, linear
attttaactttctaagaacaagttgtcaagattttttcttaacatatcatgttctgttacaatattaataatgaataccgaaaggacgaattgcaaatgaaaagcgttggcttaatcacagaatataatccctttcataatgggcatcaatatcatattaatcaatctaaaaaacttacaaatgctgacgttactattgcaataatgagtggtaactttgtcatgcgtggcgaaccagcaatctataataagttactcgtgcaaaatggctttccaccgctgtttagtttcggactaccagcaactgcagttatcactggcgncatttgcgactgccgttaagcgcggttttggtgcgtacatgcntggng

SEQ ID NO: 1130 - DNA, 200 bp; double-stranded, linear
atgatgatgagattatgactttgcgaaagatatcggtgcgccttatgaatttaaaacanantaaagaccatggtcgttaccggtagttaactttgcagctggtggcgttgcgactcctccaagatgctgctttaatgatggaattaggtgctgacggtgtatccgttggatccgggaattttaaaaccagaagatcccgg

SEQ ID NO: 1131 - DNA, 203 bp; double-stranded, linear
atgagctagtcgattaaagttaatatttgaaaatgaagcagggcattaaatgcaataaattaaataagttgtcattaaagcattaataatagaaatgattttaacaggaaaaaagtgatgaatatttggaaaagatatatatcgtgcactgtcctgagagattagatttgggaaaccaatttatccntgaatcgagatgtngc

SEQ ID NO: 1132 - DNA, 182 bp; double-stranded, linear
aatcaatataagcttttaattcttcaatcaatgatttaggtaagtttctgttgtatacgtatctaacagtattgaaatctttgttagcgtcaatcgaccatgtatttttaagtattgtctctaacaacttagcacgacgtcttaaccctttagtaaacaatccttctttagntttagtacgt

SEQ ID NO: 1133 - DNA, 485 bp; double-stranded, linear
caaatttagccaggnatacaaatacatataataaaactgtttgtaagcttacgttgacaatctggcgtaattggaaaactaatgaattttctccaagtaggttttaccctgtaaacmaaataacaattcmaataatatgraatcacaaagcgactagaaatccggtaatatgactaatcatatattcaatgtgtaataattttaacagcaataaatagacaacataataatttaacgtattaatgccgccaacaatgataaattttaaaatttcagcatgcgtttgtgttagtttcatatgtgtactcctcaacatcanaatatatgcataactacgttctcgaacatactcgaatatgcgagccaatccgcttcacttcaaatatgcttatttcaatctttataccctttcacagcaatttagtctctttnccctcatccttataggccntatatgtaaccgattatcgggtggactcattggc

SEQ ID NO: 1134 - DNA, 213 bp; double-stranded, linear
cttgttttatcgacagatgctgaacacgcagtcaaaataaataaattacataataaaattccaattaatcttttcataatatcatccttttgtttttcaattgatattcattttcaattataaaatattaraagaattagtcaacgcctgtgagtaatacacatcagtaacatttctattttcatttatgatattatctaattattaatttat

SEQ ID NO: 1135 - DNA, 526 bp; double-stranded, linear
tgtgactccatgtattcatgtatcattgtacatttgtgaattggttgaaaactgatagtgcccgtttaattacaggtactgaggatgctttcaggacatggatttgttcgaaaatatgacaatatttcactatggctcttcacttctctagggaaattgctatcttgattaatccaatcaaccaattcacctaatggtgtgtcatcaccaagaaaactttgcataaattcgtaaaagctcaatacctcacctcgattaatatacttgagccattaatataataccataaaagaatgtgtattttacataaaactttttataaagcaattttataaatctaaatttattgaatgtttaagaagttgtgtataatgaaataaacgtgttgaaatagttaggatgatgttagtggatatcaaacatatgaaatattntattgaagtcgttaagcanggaggcatgactaatgcttccaaatcattatatattgcacaacctacaattaggaaagcnattaaagatattg

SEQ ID NO: 1136 - DNA, 321 bp; double-stranded, linear
agcaaaagcaatgatgacaaaagaacaagctatgttagcagatggaagtattaaacaagatcaatatgataaacaactgttatcganaatcggaaaatcacaattagatgaattgtcttctaaagatttacaagttttagctatttttccgagagatgaatgcaggaacagttttagatccacaaatgataaaanatggaagatgttcagtgcaaaaagagtatggcagcagttttctccagcaacttttccanatttacccaggtgtttaacacgtcctattggatttgggcttaggacaattattccatatgggcggat

SEQ ID NO: 1137 - DNA, 330 bp; double-stranded, linear
ataaatccttataaaatcatgagttggacgacttatccacacaattatactttttcagttctctatatgtcaaatacctgtgaatatgttgctaaaaatagtataactttgtgtgtaatttctaattatccacaattctgaaaactataaatgtgcataagtggatamctttccttctatagagtatctgttagtgagtgtatcaaaacagtttgggaaataatttataaagtntgtataaganctgtataaggtgttcgaacattgtaaacactcatgcttcggaccaaactcatggtgatgttatgaaatttgattgctcgcatcgng

SEQ ID NO: 1138 - DNA, 459 bp; double-stranded, linear
cttgataagggaagatttgccagcaccattcgggcccatgataccaattatttcgccgcgtactggtatcgataaggaaatgtttttaagtacatgcttattacctaaaaacagatttaaatcttttgtttctaacaaacgtttatacctcctaattaaaagtttaggctaacctaattaattgtataataaactgagaatatttatcatgtcaagtaaattcgtgatataatatagacaatgtatgtgaggtgaaagtatgttaactgaagaaaaagaggactatttaaaggcaatccttacgaataatggcgataaaaactttgtgacaaataaaatcttatctcaatttttaaatattaagcctccatctgtaagtgaaatggtaggacgtcttgaaaaagcaggctatgttgaaacaaaaccatacaaaggtgttagattaacagaggatggttt

SEQ ID NO: 1139 - DNA, 165 bp; double-stranded, linear
taaatactctcgccggttatttcgcttcctctatacggattggcgaaagatacggtgcatcggtttcaactagcaaacgctccattgacacatgcttagcaacttctttaggctgtttagcatttttaaatgtcacaggtccacctaatgaatataaaaattcan

SEQ ID NO: 1140 - DNA, 214 bp; double-stranded, linear
acctgaatgcccatcaatgacagactggataaagaaaatatggtacatatacactatggaatactatgcagccagaaaaaaatgaggtcatatcttttgtgggacatagatgcagctggaggccattatatttagtaaactaatgcaggaacagaaaaacaaatactgcatgttctcacagcaggagctgaatgatgacaattcatgaacataa

SEQ ID NO: 1141 - DNA, 229 bp; double-stranded, linear
gtttctagttgtttatagttatcgcatctcttgatgtaaaatctaagatgtttatgcatttctagatgttaattcttcgctgcttaagaattatcttgatggtaaatctagttgtgccatgcattttctcatgatgaatctaaggtgttaattcattgatgtgtgctgtttcttgnngcttcattatcttgatggtgaatttcgttgtctaatgcactttttcaaatga

SEQ ID NO: 1142 - DNA, 311 bp; double-stranded, linear
ttatgaatcgtaaacactattatgaaattgcgagagtagtatggacaattagaatgatggtttgagatnaatgagtgttattaaccagtgcgtcattttcaaaattagatgccatttgctgtttataataagaagatttgataattaactatgataagaaaaaataataatcccctaaatacattataaacaaattaaatgataarataataatatatatttctactaaagttgtttggaggtaaatgtgtgaataggaatatcgttaaactagttgtgttcatgctaattttagttgtagcagtagcggg

SEQ ID NO: 1143 - DNA, 403 bp; double-stranded, linear
gatcatgctgcttatgaattattaaaagagcaattagaagatgtgcttgatacattaactgatagagragaaaatgtattacgattaagatttggtcttgatgacggcagaacaagaacacttgaagaagttggtaaagttttcggtgttacacgtgaacgtattcgacaaattgaagcaaaagcacttagaaaattaagacatccaagtcgtagtaaacgtttgaaagactttatggattaatttatatcaattttaatgattgataccaagacatgaataagcgcttatttatttttagattaagatttaacttgagtgaggttggtacattgaataatgttcaacctcttttttcataaaggagaataaaatgatttcgttaaataaccgattaacgacn

SEQ ID NO: 1144 - DNA, 612 bp; double-stranded, linear
ntttttattgacgaatngatttggatgccagtggtttggtcctaaatcttgaatggtaatcggtattttgaagttgtcatgtgctacacggtaaccgataccnataagtacgagtgcgatgacaatggttgttacgagcaagatgtattgtaaccattgcttgaacacaacaagttgtatataaggcttcattgacgatacctccaaaccaatacagctaaattaattatcaaaagtgcgatgaasctaagatagaaactagggtgcagttctaaaatgtagttgtttaaaataatttctaacaattgatttgttacaactgcgaacggttgaatattgaaaacaccatttgctatatgttgtaaaaaaatcgtaggtattgttaaaccagataacaccaggatgacaatagctaatatgactttactaatactattcaacaagcctgttgttaaaagttcgatgagtaataaccacagtattaaaaaggtaacataatagcttaaatgaatggctaacgttggccaattatataattcaaagatattcggaatactgaacacaatccaaactacaccaacgatactccataacatagtataaaaccatgtn

SEQ ID NO: 1145 - DNA, 223 bp; double-stranded, linear
gaattaattacgcaatatccgcatcttaaatcagtaatcgaaaaatatgctttaaaataaaagtgatcaatgaagtggtttgaaggttgtnaataaacctttgagtcacttccatttttaaangtatcctggatggaaccagaatagatttgaagcttcagcggtttttaatgaaaatagccattaaatgatttggaaacggtaagagggggtatttaaaatg

SEQ ID NO: 1146 - DNA, 598 bp; double-stranded, linear
cgctacggttgtcacgtagagattaaagacattcgttttagcagtcttttttattgaagtagacaatgcaagattaaatggtagtgtcatttcattttattcaactgctagtaatacaatactcagtgttatttctgaagactggttgataatgagacatgcatatttacaaaactgtgtatattgtgtatattgtatatatacagaagttgatagggggacgttgatgaaaataattttaaaaaacaatagtgattttccgatttatgaacagattaagcaacaagtaaaacaaaatattttaaagggacatgttgctcctggagagcatttgccgtcaatgagagaacttgccaaagatcttcaagtaagtttgattactaccaaacgtgcttatgaagatttagagaaagacggttttgttacaacaattagaggaaaagggacctttgttaaggagcaagatagttctattttaaaagagaaacaattttttaccatgaaaatttgggttaaaggaattgggttaattaagcncaagcccatccgaattgccacttgaggganttccaggatatttnaccgtcatttattgagg

SEQ ID NO: 1147 - DNA, 400 bp; double-stranded, linear
caaatccaagtgcaacagctttatcaaccgctaaagctaaatccgtatcagctttttcagcttgaactggtttgatttgtaactgttctgttagaagttggcgttcttctttactgactgaatcaaagtctcccactgagaaaaaagggataatttgatgcttcaataaaatcaaagcacctctatcaacgccgccccatttaccttcattacttttggcccaaatatcttgcggcaagtgtcgatcagaacataataaatttatatgcatatacactcaacctttcaatgcttgtgtgactttttaaaatcccctggttaaaggaaaatgaacnggttaccagcattgtaggcaccatttcaacaccaacttcggcggatcnggattacgcctccatcc

SEQ ID NO: 1148 - DNA, 352 bp; double-stranded, linear
ttttatgggtcgtattttttaaagaacagtcatctcaatcaaaagaatagaattatgattaaaattgatgtrgtgtaattaaagtaagaaatrrkaaatttcctagatactagataaatcgttcaatattttattaataaggaggccaatgaytgtgaattatcttaaacataagttttataacttgttaactacaatgattgttctctttatttttgtactttctggtgcgatttttttaacatttctagggtttggtttatatggattaagtagaatacttatttattttaggttgggtgactttacatataatagaagtatgtacgataacctatnatattatggcagt

SEQ ID NO: 1149 - DNA, 916 bp; double-stranded, linear
aaagcacctctatcaacgccgccccatttaccttcattacttttggcccaaatatcttgcggcaagtgtcgatcagaacataataaatttatatgcatatacactcaacctttcaatgcttgtgtgacttttttataatcctcttgtttaaagaaaaatgaacctgttactagcattgtagcaccattttcaacacaaactttcgctgtatcggtatttacgcctccatcaacttcaatatcaaagtttaattgacgttccattttaatagcattaagacccgctattttttctacgcattgatcaataaatgattgaccaccaaaccctgggktaactgtcatcactagtacataatcaacaatgtctaaaataggktcaatttgtgatatkggkgtaccaggattaattactacaccagcttttttatctaaatgtttaatcatttgaatagcacgatgaatatgaggcgttgattcgacatgaattgaaatcatatcggcaccatgttctgcaaatgatgcaatatacttttctggattttcaatcatcaaatgtacgtctataggtaatgttgtgccttttcttactgcatctaatattggtaaaccaatagatatattaggcacaaattgaccatccataacatcaaaatgaactccgtcgacgcctgcttcttcaagtcgttttaattcatgttgtaaatccaaaaaatcaacagataataatgatggatatagttttgtcatttaatatctaacctttctatttgaaatttcattaaatagttgtaaataatggtcgtatctaaattgcgcaatattccctatctctaattgatgcntaaccattaccattagggtccttggnaaggntaccaatcccaaaccttaccatggttcccccataacggttt

SEQ ID NO: 1150 - DNA, 400 bp; double-stranded, linear
aattggttgtggcttcataatgtgcagttgctagactgacaacaacatcgttttctaagcctacgataaagacataatcgttttcggttttgttgttttctaatgagcgtttgatgatacgtttatcttcagttaaagataaatttaacttagtatcgtaaagtttaagtgcttcgttgtaatgtggatctttgacagattgaatggttttaaattccataagaacacctccccaatttaaataatattatagcataatcgcctgctgtaaaagactgttcataaacttttaaatggtataaaaaactgtactatcttaaattagacagtacagtaatctcattttgaattcagtgtgataactaagctttgggacctttagatgcnttcacaaaatgtg

SEQ ID NO: 1151 - DNA, 156 bp; double-stranded, linear
caccgtagttgctaccgaataccaccatgtcgccaggttgtgctaagaagtccggtgtattttggtatacagttagctaatccgtcgaagttgttagcgacggnatatcttttgacctaaaccttttagagtaatccaaacaaaactttccaacca

SEQ ID NO: 1152 - DNA, 233 bp; double-stranded, linear
tcaatatatttattttctaatgttagcattagactgtcaattaacttgctaagttgttcttttttagtaattaaataacgcatataatcatctaaatttttcattttttcatctagcattaaaaggtagtgcttgatattatttctactgttgctccaaaaactgntcaaatatacgtcacatagtcatactacacctttatatagtttaaataccaatngcatgacctcgtg

SEQ ID NO: 1153 - DNA, 339 bp; double-stranded, linear
tatattanctatcgtttagtgaatcgtttttttaaagtaaagagaatttcatatattactggtacaactacaagtgttaataaagttgatgaaattmaaccaccaataactgtagcagctaatcctttcgaaataagaatcgngctatcttgaccaaataacanaggaactaatgcaccaattgttgcaatcgccgtcattaatatcggtctaattctagtaccgcctgcttcgattaatgcttctttcatctccatgccctgttgctcattattaataacacggtctattaacacaatggcatttgttactacgatnccaattcaacattagcatacc

SEQ ID NO: 1154 - DNA, 817 bp; double-stranded, linear
gtcacccgaggagatatncaactattaccatcaagatgngaaaaatggtgccttgggcaattggttttttcattttaatcttaattattatattgttctttttactaagaaacttcaattcacctgaagcgcaaactaaaatattagtgaatgcgattgagaataatgataaacaaaaagtagcaacattattaagtactaaagataataaagtagattctgaagaagcaaaagtatacattaactatatcaaagatgaagttgggcttaagcaatttgtcagcgaccttaaaaatacggtacataaattgaataagagtaagaccagcgtagcttcttatattcaaaccagatctggtcaaaatatattacgtgtaagtaaaaatggcacacgttatatctttttcgataatatgagctttactgcacctaccaagcaaccaattgttaaaccgaaagaaaaaacaaaatatgagtttaaatctggtggtaagaaaaagatggttatagctgaagcaaataaagtgacgccaataggtaattttataccggggacatatagaattccagctatgaaatcaactgagaacggtgattttgcaggccatttaaaatttgattttagacaaagtaattctgaaacggtagatgttactgaagattttgaagaagcaaatatatctgtaactttaaaaggcgatacaaaattaaatgatagttctaaaaaagtaactataaatgaccatgaaatggcattttcaagttccaaaacgtatggtccatatccacaaaataaagatattaccatttccagctt

SEQ ID NO: 1155 - DNA, 322 bp; double-stranded, linear
anagaaaatctactcttttatttcaccggtcctttcntatctctcatttggcatactcctttttccatattttccactttcantacagtgaatttacatgtaattttacaaatacaataggagtgcacaatggaatataacacttatctttataaaattattttatatattgacgcacttaaaacaatctacaaataaaattattatttttagttttcaatgaataattcattcttatctgttggaaaaacccatcaactcaatagcattgaatttctaaaataaaaaataccttaacgcatttaaaaatacatttaactgc

SEQ ID NO: 1156 - DNA, 777 bp; double-stranded, linear
gtttccaanggaangngaaaagcgtcaaccaatgtaactatttaaagtcaaagtgtttgaccaaatttgacttaatatgtaaaataatgagtaacagttattacaaggaggaaatatagatgaatttaattcctacagttattgaaacaacaaaccgcggtgaacgtgcatatgatatatactcacgtttattaaaagaccgtattattatgttaggttcacaaattgatgacaacgtagcaaattcaatcgtatcacagttattattcttacaagcgcaagactcagagaaagatatttatttatacattaattcaccaggtggaagtgtaacagctggttttgcgatttatgatacaattcaacacattaaacctgatgttcaaacaatttgtatcggtatggctgcatcaatgggatcattcttattagcagctggtgcaaaaggtaaacgtttcgcgttaccaaatgcagaagtaatgattcaccaaccattaggtggtgctcaaggacaagcaactgaaatcgaaattgctgcaaatcacattttaaaaacacgtgaaaaattaaaccgcattttatcagagcgtactggtcaaagtattgaaaaaatacaaaaagacacagatcgtgataacttcttaactgcagaagaagctaaagaatatggcttaattgatgaagtgatggtacctgaaacaaaataattcaaagtaaagagtagactaagcngtctgcnctttttgtatgagtaaaccaaggtgtcaataatttgtn

SEQ ID NO: 1157 - DNA, 155 bp; double-stranded, linear
taatgttggtaaatgggttaaggctcaaggtcgtattgaagaagatacatttattagagatttagttatgatgatgtctgatattgaagagattaaaaaagcgacaaaaaaagatnaggctgaagaaagcgtgtagaattccacttgcatactgc

SEQ ID NO: 1158 - DNA, 400 bp; double-stranded, linear
gactggtaaaatttacttgcaagtaaagctaaaaggtcaaatagataaagaacaacttgtttttcaaaatgacaaaaatgaagaatttccttttgttataaaagatgaaaaggatgacacaatagtaagaattttaattgaacagcatatggataaaatcaatatgcatgttaaaacgttggctgaaaagaaaaatctagataacaaagaaatggtgtattctattcattttaaagagaaaaaagtacaacatgatgatgcaaaagaagtgccttcaaaacatcaaaatcaagaaaataatcaagatcagcttaaaanagatattgatgacaaanaagatagtcaaaaatcagatactaagggaaagacgtactagcctttttactggaaaaagggttta

SEQ ID NO: 1159 - DNA, 347 bp; double-stranded, linear
gttggtacagtgttgagtggctttgaatatcgaacacaaaaagaaaagtatgacaatttatataaatttttcaaagataatgaagagaaataccaatatacaggctttacaaaagaagcaataaacaagacgcaaaatgtcgsatataaaaatgaatatttttatatcacttactcgtcaagaagcttaaaagaatatcgtaagtattacgaaccattsattcataaaaatgataaagaatttaaagaggatggaccagccagaaagagtgattacgcgctatcagtcagtacacatgttagtccaggaatttctagcatcngtgtgtgaatgangggtactttatn

SEQ ID NO: 1160 - DNA, 203 bp; double-stranded, linear
atagttattaattagtagaatgaggatatttaaatataaaggatagtgttgaacttatggacatgaatttcgattatacatgaacggtgttgtagaacaagcaaggaatgaaattgaatctgcgggatatgagcaattaactactgcagaagatgttgnaaagtccaagatggncacctagttatgatcatctgtatgtggtg

SEQ ID NO: 1161 - DNA, 203 bp; double-stranded, linear
aattttccntttccattgacataacaatatttaatggggcccagttacaggaaatatcagtttaatttcgtcttcaataccatagtcataatattgagtttcttgtgttggaaaatttcctacatagttactcattttaatttgtncaatgtttgaattcggaggcactctgttagcatatctttaaacattaaatatggata

SEQ ID NO: 1162 - DNA, 220 bp; double-stranded, linear
gccattttgttgataaaggtatactaaaggttatcgttttgaaatttttagtaactaggatatgtttcgtgttataggaccggaatttgtggtatacggtaaaattttaatgctattggaatttttaaaaatggaaaaacatggacattnaaattggaatttcataatatgtcctaattggacttaacttgttgggagttcattttactatttntatggt

SEQ ID NO: 1163 - DNA, 409 bp; double-stranded, linear
ttcacgtgctttgccatcttttaagaaaaacacagaaggcttttgcatttgattgtaattggatgccatagagtaatgatatgcaccagttgataatatagcaagatagtctccacgtttgactggatgaaggtaatttagcgtctttaataatgatatcaccagactcacataattttccagctatagttacactgtcatctgcttcttcatttctattaacaagcaatgcttgatactttgcgtcataaagtgcagttctgatatgatcactcataccgccatcgattgaaacatatttattartctctggaatttctttaatggttccaacttcatataaagtaacgccagcttcacctacaattgatcgtcccggttcaatacctatttctggtgcatctatacc

SEQ ID NO: 1164 - DNA, 400 bp; double-stranded, linear
ctaaataattgtttaaatttttctttactatttagactctttcgtttgccatgactttgttgacttgcaatgatatgaacttaatttttgcgaaaaaaggaatctagattcatatattcggtaaatctaccttcttcatctttttgaacttgtaattctagcaattcacgttgtatcaaattttgaataaccattgtaatatcacgtggttgcatagttgagcccttctgaagcaattcaattgaaggcgtttatttgagtttcgaagcataaatcaatttaagcaaaagactaaatctgctcatctaaacctaagtcacgtaaggtctaataatcnctcgtatcactacggtctgctttaatgatattanccagtncgtgcccctttaaattaaccana

SEQ ID NO: 1165 - DNA, 327 bp; double-stranded, linear
tcgtgattattattaacattttttagtaattgataaaaatcttttctcgcttctgtagggctagtgataatcatataaaccctcctttgttttctgttacgctaattatagcgtacgcacttgagtacgtcatattaccaacgagttcatcgtatncttaatacctatatgctatcgttcacaactttggtccttttctcccaacataccgcctataatgctcaaaaggaaatcagcagtggacacactaccgtnccctaccgcttaaccattttcgggcttaaatattttnaaaattttgtgaggatccgcttaaaaaaccccata

SEQ ID NO: 1166 - DNA, 148 bp; double-stranded, linear
ttaggatttcaaaaatatgtcaggttttctaacataaagcttaaaacattgatataactgcgatttcgacttctaaaacgacatraaacaatctacagctaaaatattttttcaatttttaaaaataatcngataaatctccgcaaaa

SEQ ID NO: 1167 - DNA, 243 bp; double-stranded, linear
naaggttatcgctcgtaaagatgttgttgaagaagtatttgacgacagagatgaagtggatttaagtacagcgcttgttaaaaccctgcatatgaaattggtgtattacgagaagagtacactaaagttttggtcgtgtaggtctcagcagcgaacagcagtatgcacgtctncgtgtgctgacgtgaattttatttgaggattatagacaagagagacaacttactggattttgccctgttg

SEQ ID NO: 1168 - DNA, 321 bp; double-stranded, linear
ttatatactactataaagtaatccaactctcaagaaggtaaatgggcaatcaaaagctaaagaatataagctgaaacaagtatagaaagcacagggcaagcgcaattaaagagtatgcacctacgatatgacgcacaaatgtttagggtaggtgttgacatgtgtacaaaaaccagcagaaaatggttgtattcttagggaagcattcatcctgtttgtttatggattcatgttacgttacgcaatatgtttttatgtagcacagcgaagttacaagtttatacgctatatatccnttgatnataagcagatgaaancggc

SEQ ID NO: 1169 - DNA, 191 bp; double-stranded, linear
tctacatataaaattactctaaaaatatgtatagtcataaattgttggttgatttaattaaaagtatggaaattaaggggctcttatgtatataaaaaaatgaattatgataaaatgtaaganaatatttagggtcgattggagagataccagtggtaccaattagaagacgacagtttaatgttaccata

SEQ ID NO: 1170 - DNA, 303 bp; double-stranded, linear
aatgtggcaaggatgtgtgatatgactacacatttaatatcatcctacataataattttgcgcgccaaattatcacacataccacacctacgataacaaccagcaaataaggagatagctacacgtatttatcgtccaacgcactactatatgttgttgnatgggcacaagttacaagtgctgcgcgatancaaaaggtatacccctaaaacgtcccaaaanaatcggttgccctctaaattgtttgtgtgccatgattagtaagctcctatgttagaaacaaatttttaatatgtatattag

SEQ ID NO: 1171 - DNA, 299 bp; double-stranded, linear
aaaaaggtgagaagacaataacgnacgccaacactaaaaaatccattaactggagaaattattagtaaaggtgaatcgaaagaagawatcacaaaagatccagttaatgaattaacagaattcggtggcgagaaaataccgcaagtcataaagatatctttgatccaaacttaccaacagatcaaacggaaaaagtaccaggtaaaccaggaatcaagaatccagacacaggaaaagtgatcgaagagccagtggatgatgtgattaaacacggaccaaaaacgggtacaccagaaaca

SEQ ID NO: 1172 - DNA, 821 bp; double-stranded, linear
ccatagcaccatacccataaccaacccggatccactaacaaataagtaataattnacacgtaaagaagtaaatagtttgtttagttttttatcaacattatcaatgttttcctcgacagacactggaattttaacgatagctgtaccatttgtaattgagtagttcgttatttcacccatactactatttggtaaaattgttaattctcctgaaattgtattgattcgtgttgaacgaagtccaattgatttaactgttccctctgctacagttgtaccaccgttatttatcttaacataatcacctacatcaaattggctttcaaatataataaagaatcctgtaattacgtctttaactatagtttgagcaccaaaacctactgctaagcctacgacaccagcactggcaattaccccttcaacactaatgccaaatttacttaaaatcgtcgtaataactataaaccaaacgatatacttcactacattttgaacaagagatattaaagttttagagcgctttttgttactctttttacttttattttgaatcttaaatccctgttcaatcattttattcagtattttaataactatgagggctacgataatataaataacaatcatagcgattttagttgcaatgttttcatatgtttctatttttgttaatggctcaaatagagatgaaataatattcatgacttgattcatgataagcgttactcccttctatatgatatatcaatattgtattcatattttgatatacttcccaacctacgaaagtctcaatatatctagaatcaaatggtcac

SEQ ID NO: 1173 - DNA, 318 bp; double-stranded, linear
cccgaaattaaaataataatgtatgaatttttaaatatgatttaaacgttttcagtttttatgaaaacgcatgcattttacaaataaaaatggtacgatggcactggttaaaacgttttactaaaaacaaatcatgaggtgtataacatggctgtctcttgatcagatcttgatcccctgcgccatcagatccttggcggcaagaaagccatccagtttactttgcagggcttcccaaccttcccagaggncgccccagctggncaattccggttcgcttgctgtccataaaaccgcccagtctagctatcgccatgt

SEQ ID NO: 1174 - DNA, 206 bp; double-stranded, linear
gttttaaagcggttataaaggtaaatatgcaatattataaatatcttcttcagaactaaccgaatctcttaaactcatctgtttagatagcgtttcaaattgataagttttaattttaaccgttacagttttagctgactgctgtaatttatttgacgtgcagctgttttcctgacaatnccatactgtcttaaanctctgcatca

SEQ ID NO: 1175 - DNA, 653 bp; double-stranded, linear
tctgcatcatgatattttacatcatcacttataagaacgtcacctacatttaaactttcatctaaagctccagcagaacctgtattaataatgacgtccggtttaaacttattaattaataatgtcgtagaaattgcagcattaacttttccaatgccactttgggtaatcactacttctctatcttttaaaatgccagtataaaatttaacatgtgcaactgaaatttcgcttaattgtgttaatttattttttaatattgttacttcttcttccatggcaccaattataccaatcatcttttgattcacctcttttaaaaaatcctagcatttgttattttatcacattttaatcactacaacgacaagtatcatgattttcattactgtataaaacttttgctttatttttataaaaagctctttcaataacttggtatcataaataattatttttgaactcataacagtgaattcgatgcttctaatttgtctatttttcaaaaactaatcatatcaattacatcaaccaatcgtgtcaagaaactttattaaataacaggaaaatgatatgtttaaaataataatgatgaaataagaggattttacaatggctgaaaataatcaaaatagtctcgtaacaaagatagc

SEQ ID NO: 1176 - DNA, 410 bp; double-stranded, linear
acatggccgttngnatcaagatcgtcaacgattgattggtacaattgaagtgcctatgacattggcaaccgttggcggtggtacaaaagtattaccaatttgctaaagcttcattagagctactaaatgtagagtcagcacaagaattaggtcatgtagttgctgccgttggtttagcgcaaaactttgcagcatgtcgcgcgcttgtgtcagaaggtattcaacaaggtcatatgagtttacaatataaatcattagctatcgttgtaggggcaaaaggtgatgaaattgctaaagtagtgaagcttgaaaaaagaaccccgtgcaaatacacaagcagcggaacatattttacaagaaattagacacaatagtaaaggcgatagcgattaaagaaagttaagtcagtc

SEQ ID NO: 1177 - DNA, 146 bp; double-stranded, linear
catcaagataactacggttataatccaaacgacccaacatcatataactatacttacactattgatggcacaaggtaactaccattacacatgggaaaggtaactngcatccaagtcaattaaaccaagataatggctactacagc

SEQ ID NO: 1178 - DNA, 225 bp; double-stranded, linear
tgttcctggtggaactttggtttcttaatgtcattccaaattgctgtatattcattcattggtattgaacttataggtgtactgctggtgaacgaaagatctgaaaaaaccttaccgaagcaattaataatgtactatccgtatttatatctatatcgtggtnatataatatgtcatcaactggatntacgtcaatagaccttcgtaaccttaatatcgcgacat

SEQ ID NO: 1179 - DNA, 319 bp; double-stranded, linear
tgtacgcatatggtatcacttgatgaccaattcactttgtcgagaataacgttatttaaagacattgatttaaagaattggtattncgttaattgtattagacttttcacagaagtagcgacaacaatgatttcatcgtaacacgtgcgcatatnaagcatgggaaaagacatggnctattgacctggccttttgtgcactcgtacgattggtcaaacgtggctatattgaaagtttgaaacaagatgcgacggacacacatgcacgggtggggatagatcttgagtcttattgagacgctgtgactgtggctgacatc

SEQ ID NO: 1180 - DNA, 654 bp; double-stranded, linear
ttttatcttggttttgaactagatatgtgtagtcaggtataacataatcaatccctaataagttatcatcagggaatttgatacctgcatcgataatgacaatttcgtctttatactcaactgcataagtatttttaccgatttcacctagacctccaagtgcatatacacctacttcatttggatgtaattgtttcattatttagcaatctccacattaaagtgttctgagttttctttttcgtaatctaaatgtgcgccctctaatttagtgataaattcgatattaaaattacgatctttcaagtaacgacgtacttgttcttctgtttgagcttcaacataaagtgattgtgtattttcacgcacaattacctcgtctctgttatgttgataaaaaactttaaatactgccatgttaaaaattcctcctaagaatgtttgtytaatttattgttaaccctagtaaaatcgtattggagtatatatcgataaattcattccaatcatctctataatgtaacttaataacgatttggttaataactaggttcatcatgtcgttcattttaaaaaattagtgaaataacactaaaatttcagttaaatcttattttacatgatgaatgataataaataaagcagtttatctca

SEQ ID NO: 1181 - DNA, 231 bp; double-stranded, linear
cgggtatattatagacaacgtttaaggacttctttttaactaacttgttaaatgttgctgtatttttgtattcaacactgtaatatagttcttctgacgctgatgcattactcattgtaatagatattaaaagactcaatattattaaactaataatagcgcgctttatgattttcatattctaatctcaaatgaattccagaactttatatggttcaggtgcgacaacat

SEQ ID NO: 1182 - DNA, 245 bp; double-stranded, linear
taagtttattaagctcttgtccgttagcaatcacgctaccgctagaaatttggtcaattgaacttagtacatttaataaggttgtcttacctgatccagaaggccccataatcgcacgaattcgcctttttgtatgtcaagtaatatcttaggctgaatggtgctttacgagtttgaacagtgccgaaaacgcaagccccttgatatcttaaatgtggagactacaacncatcagtgncacggga

SEQ ID NO: 1183 - DNA, 490 bp; double-stranded, linear
aggtaaagatgatggtgtagaagtttatgtgcattgcgaagatcatggcattgtatttaatgcaagtctacctttgtacaaagatgccatccatcaaaaaggatcaatgcgtagtaatgacaacggtgatgatatgagtatgatggtgggtacagtgctgagtggctttgaatatcgagcgcaaaaagaaaagtatgataatttatataaatttttaaaagaaaatgaaaagcaatatcaatatacaggttttactaaagaagcaattaacaagacgcaaaacgtcgggtatcaaaatgaatatttttatattacatatttatcaagaaatttaaaagaatatagaaaatattacgaaccattgatacataarcaatgataaagagtttaaagaaggtatgcaacgagctagaanagagctaaactatnctgctaatacaaatactgtagcaacgttgtttagtacgaatgatgaaaggaatagaaaaga

SEQ ID NO: 1184 - DNA, 153 bp; double-stranded, linear
ctcgcattttaataaatcatactcttcttttcttgcatacgaattagaataactcgcgagacctataagtctctttcctcactagatagtttatacttttggtcngttgaagtcaataattttatctaaagctataaaaaatcttttgatagc

SEQ ID NO: 1185 - DNA, 164 bp; double-stranded, linear
tcatttatatactgtatcacgctatctttagtatgtgtgcatnatcattcgttagtgcgttctaatttattgatgttattgcaaagtaatatcgtacaagcatcaagattacgcggtatgaatgaacgttatattttaattcatgatttactaagaccaacaat

SEQ ID NO: 1186 - DNA, 143 bp; double-stranded, linear
cacaagtgacgtcatattataaaagtcactcggtttgcgatacgttctgtctaagaaatagcgacgtgcaatttcatattttntataaacatccgttgaaaaaggacataaaaccatgcgttgaaccagggtctatactttct

SEQ ID NO: 1187 - DNA, 209 bp; double-stranded, linear
cgtacaagttaaaacgtttatacgattacgaaaaaccaccgaagagtgagaaagatccaatggttgtatatgcagtaagtgcaggatacaaatggttctttgcttatccagatgaacatatagagactgttaatacattancaatccctaaagatgtctgtttattagctcagcatgancatacagttcggtcacatagtgtcaattca

SEQ ID NO: 1188 - DNA, 243 bp; double-stranded, linear
ttggaatcgctgtcgacggatagcaacctggattgtaaaaataatgttggctttaaaaataccgtggcaatattaaatgaataatcgctgctgaatatacacccaatgcacattgaactaacataancccatttgactcatctacgcccactattggctttatagtcactgaactaagctaataccnatcctaacatacgaatactaggaaggtagtatatgatacgcaatccatatcaatat

SEQ ID NO: 1189 - DNA, 527 bp; double-stranded, linear
caccaggcattaccataccagcactcataccaccaatcackctcgataacatcaataccgaaaaattgtggccaactgcaaacataaattctgacactgaaaacaaaattaatcctatacatataattaatttcttccctaatttgtcagctagcgtaccaccaaacggcgatataatcatttgagataacgcaaaagcagcaactagtaatcctaaatcactaccagttaatcccaaatcttttaaataaacaggcaagactggtattactaaaccgatacctaaaaaaatcaagaaaatattaaaatataagacaaaaatctgtttattcatatgctcacctcttttttctccatgtcatgcttaaagctgttattcttcttttccacgacagattgcaattcatgctaaatattcgtaaaaagtttctatattgtattacaacattgctacatttgacaatattttttctttgtaattatcactatnttccatttaattgtataattaatgacatattnnaata

SEQ ID NO: 1190 - DNA, 889 bp; double-stranded, linear
aaaacgtggcagtaattcagtgtatgttcaatatgatgatattatgttttttgaatcatcaacaaaatctcacagactcattgcccatttagataaccgtcaaattgaattttatggtaatttaaaagaactgagtcaattagatgatcgtttctttagatgtcataatagctttgtcgtcaatcgccataatattgaatctatagattcgaaagagcgaattgtctattttaaaaataaagaacactgctatgcatcggtgagaaacgttaaaaaaatataataagataataaagtcagttaacggcgtattcaattgtaaatcttgttggattttaacaagataactagcaaatgcactgtatagctggctttttaattttattaacaaaattaaatatgacgcgtgaattaaaaaatgatgtaacgtctctttgtatacctattcctattactacataatttatcaatttctattcactctacaatcctatggcgcaatttttaacaaaatatactaaatttgaaattgacagtttccataaataaaatgctataatttcctactccgtgaatcttattttgttttaaaaaacagtgtagcacaagmttcaacttgtttcctacactgttttataaatgaattatttaaaatgcttgttcaacctcttgtaatgttggcaaactattaatagcaccatacttcgttgtcactattgcagcaacgcgattgctaaacgctaaaatttcctcaccttcattttcaaataactgagttaaatttaacacatcggttgctaaaatcctgctaataactgcaccaataaatgcatcccctgccccagttgtatcaacaggttttaccttatagccactatgataatgatta

SEQ ID NO: 1191 - DNA, 254 bp; double-stranded, linear
agttaaaggcgttgaattaatggccttcccacacatgacatataaacaagcgtgcgcctatggtctgataaccagatacacgtttgaatggattaattgcgttctcaattaggcgtgatatggctttaaagatttnagtctgttgaaatgatggtgaattaaagcattgcgctaaaggtgcactgacaatatctcgtaaagatatggtgctttaacagatttgtaacatctatggtctaangatacggggttaa

SEQ ID NO: 1192 - DNA, 189 bp; double-stranded, linear
ggctcataagttacacctaatgcatcttcatctggaagctgtggtttatcatcttctaaatcagcagttggcgttttttcatataattcctttggcgcaccaagatacgctaataattgagctgtgtatnctaggcatccataccgtattcgttaaaccagtatatttcagctgaatgatctgtcctac

SEQ ID NO: 1193 - DNA, 215 bp; double-stranded, linear
ttgatattgatcgatgaccggtgatgtgaaactgaaactgaccaatgaatgaaaaaatgggcaatgtttttgacaacaatggtcatttaccaaataaaaatattgncaccattaatacctgncaaacgtgtttgttcctaaacctaaaatgataaatcctattgagattatggacttggtaagctgcaatctttttaatatctttataagcaatg

SEQ ID NO: 1194 - DNA, 158 bp; double-stranded, linear
agaatttgcnactggtttaccaacgcatctatgttcggtcgctataccgcatacagatgtcgaacatattaaccatagaacgtaggtgtggtgttctagaaaaagaagtgccgttattgaaatgggacacttgatcaacagccgagtgaaatcgtttt

SEQ ID NO: 1195 - DNA, 180 bp; double-stranded, linear
actgattgccgtgtctgtggttgatcattgactaattgttggccatcattggnttcttggtctaatagtcctcttgctcctgcgtcgtaacattgatgccaatcatgcaccacagcctttcggttcatcataacatttctgccaatgtctctacatgacacgggctcatatttctttctg

SEQ ID NO: 1196 - DNA, 274 bp; double-stranded, linear
gttaaagcgaattattcacaatataaaaaatcatctgatcaagtcgtattagaattaggtacaaatggcgactttactgtcaaacagctcgacgatttacttaatcaatttggaaaagccaagatttatttagttaatacacgtgttccaagaatttmtgagggcaaatgtaaatcgattattagctgacgcgggcgaaacggaagtcccaatggtcacattaattggattgggtattaggcgcttcacaagggaccttggtggaatatttttg

SEQ ID NO: 1197 - DNA, 154 bp; double-stranded, linear
acgtaacctatattcatctctgttcccaataataataacaatacataactgatattagctgtctttcatctctaattaatatgcgtcatgagctaatatcggttatttttttgtgtcaaanaatttttattttatctctccatcgcattaattg

SEQ ID NO: 1198 - DNA, 249 bp; double-stranded, linear
aatcctcacccgtaataaactcgttttgaatgcgttgttcgaactcacggtatattaaagcaatatcctctaacttatttttagttcgagtttgcatatttttatcagcaataaagtgttctaaatgttcaggcgttactgcatattttttaaaatcttgaatttgttctgttaatttttcactaaacccataatattttgcttgtgattgataaagttttaaatacttttgttgttcntgaacaatgn

SEQ ID NO: 1199 - DNA, 165 bp; double-stranded, linear
ttggtaaaaatcgacatcaaatactaaatctgatccatctgaatcccatgtttaaaaccgaacttgtgcattaattgtaaagttcaaactcttcatcttcatagatcgcgatgcgtcttttaattctttaggtgatactttgtagatctataacaaaattancta

SEQ ID NO: 1200 - DNA, 236 bp; double-stranded, linear
ttattagcgattaaaaatatgtccttttttaataaaggagatatatgtttaattggatgtcaacatcggagtcattggcgaaaaatagggctgcggtcgatggagttcaaaactattttaatgcattacatgttgtgagtnaagagcaggcgtacttttcttttcaaggatgtgacatatcacagagcgtacaatagaaactcagataccattacatgganagtccgcgtccaatg

SEQ ID NO: 1201 - DNA, 146 bp; double-stranded, linear
taatgctaaacagtattatggagataatggcttagttcaaatttctgatgnaagtcaacacttctaaaatttgtaaatgaagcattagacaataacgaacaatcagttgaagattacaaaaatggtaaaggcaaagctatgggctt

SEQ ID NO: 1202 - DNA, 385 bp; double-stranded, linear
attgatgatagtattgatggtaataccataaacatacagcattatcacaagtaaaagtaagcctaaatgtccataaaatctacttgtcacaatatatgtcggtattatcgtaacgggaagtcatttcgtacttgattaaacttttgtgtaattgctttagtaccttctaaatacctggttgatgagaccacatactgataccaccataaccataaacaaaaggtacaccagaattgggcatacttcttattccatccaaacctccgtaacctaattgctacgggtaatattccagcacactaatagtattgatgtaattaactgaacggccgctngataataagtcttacagtcttaaacgtccatgcgcatcntnacccattca

SEQ ID NO: 1203 - DNA, 580 bp; double-stranded, linear
acattgaacgagtacagaaaacttattgnaaataaaggctgttaaagataaagaagaagatacttacagaggtaagtattttgcggaagaaagaaaaaacgaaaaattggaaaaagaaaatataaaactaaaaaacaaaatttatgaattacaaaacgaagaagataacgaggaggacgaagaagacaaggaggacgagaacgatgtattacaaaattggtgagataaaaaacaaaattataagctttaacgggtttgaatttaaagtgtctgtgatgaagagacatgacggtatcagtatacaaatcaaggatatgaataatgttccacttaaatcgtttcatgtcatagatttaagcgaactatatattgcgacggatgcaatgcgtgaygttataaacgaatggattgaaaataacacagatgaacaggacaaactaattaacttagtcatgaaatggtaggaggtatganaagtgaatgatttacaagagagagaattagaaacattcgaacaagacgaccgattcaaagtaactgatctagacagtgctaactgggttttttnagaaactnggat

SEQ ID NO: 1204 - DNA, 139 bp; double-stranded, linear
atcgtatggttgaggcgaatttaactgaaaaattagacaacgaatcttgatgaaaaganaatgattggctaaaatagcagctaatcaaatcaacgataatgaatgcttatttatcgtgctggttcatctacattggagc

SEQ ID NO: 1205 - DNA, 229 bp; double-stranded, linear
aggaggatatcagacttacaractattctttatcatactgraattcaaatagacaccttaattgaagaaggcgttgacgcgctacttttcraaacgtattacgacctnggaagngttaacaaatgtcatttccacggaacggggaaaggaaatacggcgttgccaatccattgctccaattgaaccggttgcaaacacaaattgacttggttgaaggggcaggcatgca

SEQ ID NO: 1206 - DNA, 399 bp; double-stranded, linear
tcgacaagtttttaacagttcgttattatatgaatgtaagtaaaaatttcttagctacaacttacatattataaatgcataaattaaacaaaaaggggcgaaaaaagttgactcatttatcagatttagatattgcgaatcaatcaacactacaaccaattaaggatattgctgcatcagtaggtatttcagaggatgcattagaaccttatggtcattacaaagctaaaatcgacattaattaaaattacgccaagagaaaacaaagggaagttgttttagttaactgcgatgagcccaacaccagctggtgaaggtaatcmacggttacagttggtttagctgatgcattccmtgagttaatgaaaacgttatggttgccttagggggcctgccttt

SEQ ID NO: 1207 - DNA, 138 bp; double-stranded, linear
ataaacaatacgatttgtatgctacttgtctgaagacaacataaaacaatatgttaactgatattgaggatatgggctttcaaaatccanttcaaaaaaggttatgttgaaatatgacgcggttgttgaaagagaccc

SEQ ID NO: 1208 - DNA, 655 bp; double-stranded, linear
agtcgcctaacttttattatcagtccaatcagtttcatcaagtataaatgttattgcttatttttgtattcttggcgtattttttgttcttctgcatagcgctctggatttttcttataaaaatcttggtgatagtcttcggctttgtaaaattgtgacgctggtartatttttgttgcaattgccttatcagcattaatcgtatttttaagctgctcgatataagtctcagcgagttctttttgatgatcattagtgtagaaaatagctgtttnatattgaggaccacggtcttgatattgaccacctgtatctaatgggtcaatgactgagaaaaatatttctaataacttattgtatgagaataatgcaacatcatattgaatttcaacagtttctaaatgaccactcgtacctgattttacttgttcgtaagtaggattttcaatatgtccgcccatatatccagaagttactttttctatgccgtcaaaggtgtcaaatggtttcgtcatacaccaaaagcaacctccggcaaaataagctgtattaatattcatttttgacatcctttccattagaccttagtacgatttattaagaaatcacttgctttttgaattgtttttatataacgttaatangngattatnat

SEQ ID NO: 1209 - DNA, 213 bp; double-stranded, linear
ccgnccccaatggaaattacctttggtnccccattttaattgttaaattattggagtgttgtaccagttcccccggggattcacccaggtcccattttcaccatacttagccattgttataatctcactatcttcaaataagcttgtgtatagtttaacagcttcttcagcttggttattaaacattaaaaatgtcgtgatttttggaatatc

SEQ ID NO: 1210 - DNA, 149 bp; double-stranded, linear
ttgattgcaactttgatagtgaaaacatttacatgatgttgtcactggtgcacgggcgtcgagaacaatcattgcgttattgacggtgctgccctgctgtctcagtttgttgatgcaagcactacacgaaacccaatagcntcaccagg

SEQ ID NO: 1211 - DNA, 142 bp; double-stranded, linear
aatgtttctcctaattttaaatgtttaggaatattaactaggataataaatccagcgacatcccaaatgggattcatataagaatgttggatgataatnttggccgttaatatacatattttctattataaaattgggcaaa

SEQ ID NO: 1212 - DNA, 163 bp; double-stranded, linear
tttaaatttagtcacttcaccttttaaagcatgttcataaaatgtttgcatcatcaatgcacgttctgaaccagagccttcaacacaaagataaatttgtacagcaataccgcctctaactcttcgttgcgatgatggcaataccactcaatccaacgctcng

SEQ ID NO: 1213 - DNA, 765 bp; double-stranded, linear
gtcacctttcacgtcttgaagaaaaaggctatataagaagagatccaacgaaaccacgtgctatagaaattgtaagtgatcaaacaaatgataatattaatatggaagaaacgattcatgtgccagttattggtaaagtcacagcaggtgttcctattaccgcagtagaaaatattgaagaatattttccattacctgaacacttaacatcgacacacaatagcgacatattcatattaaacgtcgtaggcgacagtatgattgaggctggtatattagacggagacaaagtaattgtncgcagtcaaaccatagcagaaaatggagacattattgttgctatgactgaggaagatgaagcaactgtcaaacgcttctataaagaaaaaaatcgttatcgattacaacctgaaaatagtacaatggagccaatttacctagacaatgttgctgtaattgggaaagtaattggtttgtaccgcgaaatgtaatattttaaaccgttatatattatcgtaattgttaagccctcatttttataaattttgggnctcttgaaaaagttacgttttcaagaggttttatttattctaatctaaattcagttcaaacagaaattgcgaattgttagataatctcattctttartataaatnttgaattacagatttctgcaaaatgttacacaaattaaaactcgcccccgtaataatttacaggagcgagccattattatttttttcnttcttttttattaagtatatc

SEQ ID NO: 1214 - DNA, 495 bp; double-stranded, linear
agttgccatcaaaaatacagaacctaatnatnaccttttatgattttttgtgaattcaaagtcactttctttttnaagctttaaatttctccccatttttttagccccctataaggattgaatatcaatgccttctttcattaaaatttctctaattttcgaaacaaataataatgcatgttctccatcaccatgcacacaaattgtatctgcttgtaacgttacttccttattgttttttgaaataactttatyyyccttcaccatctttaaaacctgcttaagtgcttcgtcagtatcagtaatcacagcatcactttcttttctactaacgagctgcccatcatcttcgtatcgtctatcagcaaacacttcagaagctgtaattaatccgacattctttgcttctgaaattagatatgaatttgctaatcctactaacactagtgatggatcaaagtcataaacagcttgtgctataacgtttgcnattnc

SEQ ID NO: 1215 - DNA, 243 bp; double-stranded, linear
antgtccaggtacccgtggtccaaaattcgatgtacgtagaccattgnctcgtatttgtcagattgtgttaatgattgtctctgtattaggaagtttattctccattttaacaattagaaaaatagatccgttaaaggcgattgggtaggaggtgtgcaaatgttgaaattgaaatgtacaagtcattaagtggatctacatgagcgtaaggtcattggaataggtttgctgtgactcgccga

SEQ ID NO: 1216 - DNA, 256 bp; double-stranded, linear
gggcttctttctaaaataactaagtgaattatctatatatgaagaggtctccaatactttttatataattcgtgattacattctatacttttaattgtattttctgcgtaggaaagtggttttattaattcgattagttcgaactacantcaagaaaaggtaaaatttgtgcatgagcaagagaaacatacctgaaccaaaggcacccgaacagtacctaggcctaagcggctaattataaatgctcaagcgcang

SEQ ID NO: 1217 - DNA, 400 bp; double-stranded, linear
tttattttttcttctaaacgaaacattgcttctttttgtgattgttttgtattcttgttcaacacaacacttacgcgcttccatttatctgtgtatggatctttatacttctcgtagtatctgtatttagtttcgttatttttgtttttaaatttttcaatccacatgtttatacctcctgagagaacgtacgttctgtaaatttgtaaaaaataataagggtaggtgggctacccaaaatttagtactaggtactaaatatgttataataaaataaaaagtaggtgataagatgactcaatttctaggggcgcttcttcttacaggagttttaggttacataccatataaatatctaacaatgataggtttagttagtgaaaaaaacaagattatcaat

SEQ ID NO: 1218 - DNA, 400 bp; double-stranded, linear
ccaagtgtcaattttagatgatttttttgttgacctatcgccttaactgaagaaactgataaatcatccatttcaaaaataggtctagaaaaatctgttccgaaggtcttaaacgattcatatcacgaatatttttaatcgttatatcattttctgttaataatacatctacttgctttacgggatctaacgaagttgttttagataattctttcatccatttatttaaaccttcagctaacgattctatattttcaatatccatcgtcatacctgcagccatatgatggccgccaaatttagcgattaactcttgatgtgctgatagtatttcaaacatcgacacttgatcaattgatctggcggagcttttgcatgattttgctccctatcaatattt

SEQ ID NO: 1219 - DNA, 458 bp; double-stranded, linear
aagatattagacataaaatctaaanacagcagtaagatgatttatgattagaaactatcttactgctgttcactttttataatacttctgaatgtcttcacttatacttctagtcacagatttaaataatcaaaagtgcacattattaaaatatcaatttcacactcaatgcggctcatcgcattcatttcttgtctagcaacgttctactctagcggaantaattagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttggcctgggca

SEQ ID NO: 1220 - DNA, 494 bp; double-stranded, linear
caaaatttatttcttgtaaagtacaatataagttaaatgttgttgttaggattgattctttcatctgagcatttaattgtaagtcgctatatttaatttgttcagtatttamaaataaattgaaaaattcaactgataataaaggtgttctaatcatacaaatacttgacggttcgtaaatagtgttcatttgtaagcacctcacatatttgaatagacaaatagagccctttcaggctctatttgctgtaatcttaacagcagaagctattaaaactaccagtcttagcacaaccaggagtacataaactatgacttgtaatacgttcgtcacctgctgaatcatttgagtnattgtttgctttaacttgcacgtctaaatcaagaactttttccatagataaaacctcctattattagttgaagttaaggcctacttcaattgtcatattatcccttttcacacaacaaatcaataaattatataattatat

SEQ ID NO: 1221 - DNA, 148 bp; double-stranded, linear
actattattttaatagtgacgacagttttaattttattaagtattgctttaattacctttatgcaatactatttcacacaaganaccgaaaatgccataagagaagatgctagacgtataagttcactggtcgaacaatcacataata

SEQ ID NO: 1222 - DNA, 401 bp; double-stranded, linear
tcgcttttacatcaaataaattatctttatacaatttcgtatgaattacttctttataattataaaaatgaggaattttttgattgtttaattcacttgctaattgattagctttttgttggtctttaattgtaacgtcgtgtggtgcagtatattttatttcacttgataaggacgctctacttatagcagcaaagcaaagaactgaaacagtaatcgctgaaatgattgccatgaccgtaagtgaaaaagcatttttcttaatacgatacataatagatgatgagaacatgacatcatttacacttataacaccttktctaaacttcttcaccattttaaaaactagagaracagagcttttaaaaaataagngtgccccaatcacagttgacaanaaa

SEQ ID NO: 1223 - DNA, 176 bp; double-stranded, linear
cttgaccaaatccattttttaacaaaagtggtcaagtgaaatcccatctttccaaatcaaaaaagagctaaagcaaaatgctctagcccttgatattactgatttcccatcattgtntagcgtattaatattgcttcatgtactgatctctttcccattcagagacttgagttctg

SEQ ID NO: 1224 - DNA, 283 bp; double-stranded, linear
aatacttttacgataattataaaggttcattcaaatcttagggcaaaatgtataatatttttatgcaaatttaaaacantaacacttatttcaaggttcaatattttgagaataaggagtgcgcgatttaacttttcagagcaaatcactccgaaatagtgttaatgatcttattcaatcaatgccaatcaaactcgctcgaaatagggggaaacgaggcnatcatttttgacaatgagtgtcaatagggaagaataacaattaggaatgactcataggagga

SEQ ID NO: 1225 - DNA, 217 bp; double-stranded, linear
aaaagaagagaagaaagttgaagaacctcaagcacctaaagttgataaccaacaagaggttaaaactacggctggtaaagctgaagaaacaacacaaccagttgcacaaccattagtaaaattccacaggccattacaggaatttaagtcggataccacgtgaatnacgtcaggatgtcngccgttcacatgacacgctctacatattcaccactcg

SEQ ID NO: 1226 - DNA, 176 bp; double-stranded, linear
tgggtactatttattacgtaaaacttttcgttagcgatgccggcattgcaagagcaaggtttacaaaagcggactaggtttgcactttctgctgttccatcgcatatggattagtaaggtctttatgggnactgtaagtgatccgagcaatgtcggataatctaggtcttggatag

SEQ ID NO: 1227 - DNA, 400 bp; double-stranded, linear
aatgaaaataaagaagatgattttgttgcatatgggtctccagaacataattatcaatttggtggaagtttaatcaaaagtaaaaatttaagcacgttattaaaaccagtacatcaaaccaaatcacctgatgagataaaaaaggaattagagtctaaaaagaacgaccgctaaaactatgcggccgttttaattttgttttcaagttaatcatacttacatataaaaatgaaaagttgaatttttagtacaatttccactgtatttatctgttaaccactttatacccgcaatatttcgttgatcttatataaacacttttggctgcttttccttgacctagattaaaattatagattttccttgtaagagtgtgtttgtagtatcataaatatgtaaa

SEQ ID NO: 1228 - DNA, 150 bp; double-stranded, linear
atctagcatgcttttggaaaacgataagaatttggtgtttgaatttcataaccaacaccagcagtttcaacaactacgtgtgtaggatataaatgtgttacttgacctttgacatacgcgtacattataggcacatccttacatactcan

SEQ ID NO: 1229 - DNA, 138 bp; double-stranded, linear
tcggtacagtgcatttggtgcgtcatggtttacaaggnaaaaataagtgatcactatttatcagtatgggaaaaagcaacgacgtatcaaatgtaccatggcttagcattattaattataggtgtaattagtggtaca

SEQ ID NO: 1230 - DNA, 182 bp; double-stranded, linear
ttggtatgtacctccaatagtaatttcaataactttgtctgttgaacactaagagcaattttaatttcataatgtgttgtaaacattttttttgattggagtttttttctgagttaaagaccttgattatnctaagaaaagtaaaagcacacggagtatcctatcagaaaaccagtatacca

SEQ ID NO: 1231 - DNA, 233 bp; double-stranded, linear
tctctttaaattgtacacaattctggataactatccccatttctgtggataaacaccttgatgtcttattacttatcctcgtttttatatcccatatttatcaacggktatcgctttttttcataaaaaaacactaccgtaccycttatttaagaaatacagtagtattattttcaatatattttagctagcntttctacgtcgtacagtcgcgattaaacctatacctgcta

SEQ ID NO: 1232 - DNA, 385 bp; double-stranded, linear
gtttttggtaaaagtactaatattaaccaagtattgagtcatatgttaaaacaagatgcgaatgatattggctttgctaaattactacaaaatgagaataatcgtatgagttataacgagttaatgagtgaatggcaatcacatcaacgtgcatttttagaagagttgaggcatgttgaaatgttaaaagaagaatctattagagcatatgatgtttataaaaattgtgagtctttctctaagattgaacaggttattaatagtgaaaaaacaagtattgaagaacaggtatatcatttagataatgaaacgttacgagacaataaagaaatagaagtttgggataatcgatttaattanattgntagcccaatggnccctttaa

SEQ ID NO: 1233 - DNA, 180 bp; double-stranded, linear
ctgaaaagattcaactaatctgagtcaggttacaatctcatgataaccgctcgcacctcggagaaagacgctcaaacagtacagagctcgaccgcaggatattttttgtgaaaatgaacgtatgagctgttcaganggcactttattgcgcaataaaacggtaaaaatcctgaagtgaag

SEQ ID NO: 1234 - DNA, 453 bp; double-stranded, linear
accattttaatttncnttatgaccttgtatgccattatcaacagttatgattaatgttatgcyttcatcatgagcatttctaaatgctagttcgtttggtccatatcttcggtaaagcggttaggaatatgccatcctacttgtgcacctaaaagttgtaatgttatcactaaaattgtagttgcggtaacaccgtcggcatcgtaatcaccataaactaggattttctcatcattcgctatcgctcttttaattctttcaatagtcttagtcatatcgctcaattgnagtgcatcatgattgatatctgtatctgaaatgatggattctattgcttgtncatcaataatcgatttacttnctaatattttttttacgattggcgttaactttaattttgatgttaattcatcacttatgtattcagctggtttagttaatttccacttatac

SEQ ID NO: 1235 - DNA, 163 bp; double-stranded, linear
cgtgattaagttggatactaaaatttgggatgttagagaatgtgatgaagatttncagcaatgtcctgaaattaatgaaataagagacattgttttaaagcggtggtttgataggtttaccaactgaagcagtttatggacttgcagcgaatgcggcagatga

SEQ ID NO: 1236 - DNA, 144 bp; double-stranded, linear
gttaacacatcgcttataacgtgtaaatataaacactgttttataaaaactttttataccattaccggcaccgataaatgtgtactatggagcacaacaataactggaatacttngatttaatcccgctataacatttcctaat

SEQ ID NO: 1237 - DNA, 204 bp; double-stranded, linear
atagtttaaggtgatattcaaacaatattaggtttgatttaactatcaagcatctactttgtcatgtttaataccagcaaataataaaatccatgtcacgataataaatggcatgttaatgcagggtaagcccaaccggtccagccatggtggtggtaccctanttggccnccacctaccggttaattaaccacccccaaaaaa

SEQ ID NO: 1238 - DNA, 157 bp; double-stranded, linear
cggtcattttggttattnaacaactatacctgaggggtggtgggtaattcgtattgccgattcagttttgttaatatgctgaccacctgcaccagaagctctgaatgtatcaactgtgaatagcatccggattggtttcaatctgctatggcatcat

SEQ ID NO: 1239 - DNA, 164 bp; double-stranded, linear
ttaaagcatgttcataaatgtttgcatcatcatgcacgttctggaccgagccttcancacaaggtaatttgtacagcataccggctctaactcttcgttgcgtatgcctgcaatttcttacctcgatacttaagtcaattttccgggcataagggtgttcattt

SEQ ID NO: 1240 - DNA, 239 bp; double-stranded, linear
ttgaaaaactgaaaacggtgaagttttacaaacaactaaaacagataaagatggtaaatatcaatttactggattagaaaatggaacttataaagttgaattgaaacaccatcagttacacaccacacaagtagttcagaactataagttgatcaatgtctcacacagtgcataatngaacaacatgccggtctcaacactcactaggcagaggatcataacggtcgtngtaagctcgg

SEQ ID NO: 1241 - DNA, 152 bp; double-stranded, linear
tgataaataatagcgccatcataagttgcagggtggtaatcataatttctaccatgagtctttgccttgaaagaccgtgcaccactttcttttaaatcggtaaacgataatgncaagtttaaaataatttggcgtgttggcatttgagtatc

SEQ ID NO: 1242 - DNA, 148 bp; double-stranded, linear
cagttcctattcgnaaaactgtcccaatagatataatttatggtttatatctatttcggcatctttacctttcactgttcacttatgtaccataatacttctgacagttactaattaacagcaactctaactcatttatatttaacta

SEQ ID NO: 1243 - DNA, 588 bp; double-stranded, linear
ggtaccaatcgatcgttacaaacgtttcgttaaagacgataaaaaagtaccaacaggcaatgaatatcgtgaattagtattaaaagcaattcacatgattatgcttggtttcttgtataaatatattgttgcttactttattaacacatatgcaatcatgccgttacaattagacttacatggctttgtcaatttgtggttatatatgtacgcatacagcttatatttattctttgactttgcaggttatagtttatttgcgatagcatttagttatttattcggtattaaaacaccaccaaacttcgataaacctttcaaagcgaaaaatattaaagatttctggaatagatggcatatgacattatcattctggttcagagattgtatttacatgagatctttattctacatgtctcgtaaaaaattattgaagagtcaatttgcaatgtccaacgtggcattcttaatcaacttcttcataatggggatttgggcatgggaacgaagtgtaataccattggtttaaggggttaaaccatggccagccttggttaaagggtanggnccaataaggacggtgggcgg

SEQ ID NO: 1244 - DNA, 376 bp; double-stranded, linear
attgctggagaaaggcaaggctttgcaggcggattgaactcgacattcactagtatgggtaatttcataggtcctttaatcgcaggtgcgttatttgatgtacacattgaagcaccaatttatatggctataggtgtttcattagcaggtgttgttattgttttaattgaaaagcaacatagagcaaaattgaaagaacaaaatatgtagcataagtattttggtgtatattgatataaagtaaagcgtaatattatgaatgattagcatcgtttttcttatgaattttattaagaaaattcgatgctttacatttaaaaagattcgattgactaaatgttttactctttatatttaaatgttatatgtnacaaaa

SEQ ID NO: 1245 - DNA, 288 bp; double-stranded, linear
caatttgttctaaagcaaattctttacatttctcacggaattcagctgttgacattttctttcggtcaacaccttttttcgttaatggcttgttcaattgggtaaaccatgtggttatcccccaacctgggtaccgtatggggtggccattaggaaaccccttggcaataggttttttaataaaccggtancaaattaaaaggtccttttttaaaaaatttttggtttccaaaggggccaatggntcccccaattaatggttaaaggttttaaccccaattttccggc

SEQ ID NO: 1246 - DNA, 161 bp; double-stranded, linear
catcatcaatagaacggtattcgcaacgtcgtagaaatcccttaaacgacgagaacaaagcaagtcgacatcagtaaaacattaaagatattatggctgaagcagagaacttaataactttttataaatctataccntccaaaatgtaaaactaccaaaat

SEQ ID NO: 1247 - DNA, 421 bp; double-stranded, linear
tcactacgttgtttaattgtggtaattgcagttttacaggcttgtctagtgaagatttaaaacttaattcaagtgttttagtcatgaatatgtcctcctgattaaattgataaagatttgatgagttcgatattgctatatgtttctccagtaagtcgctcaataagtttgctgaatgttttaatttggtcgtttgatgcatcagggttaatgttagcgaatcgacgcttaaattctgtttgtttgccgttagcgtctactttagtaaatgataatacaatagtgatgtggtttattttactcatattttaaaacctcctttcacactatatatcgaaacaaaataataaaatggctaattttattttctatgtttaaaatctataaaanaggcaatagatatgtgtaactaaaatatang

SEQ ID NO: 1248 - DNA, 409 bp; double-stranded, linear
ataagctgctgttgataatccaagtgctaaagttaaatataatatagtgccaaaaattttattcttctataaaaacacctcttcatatttaatccatatctctttttcgttatttatacagaattttctgaaaatagtcaaggttaatttatttgctgcaaatttcaaccactttatgttaaatggacatcaaagtataattgtattattattaaattgtgcagtgtataaatagacgatatgcaggaacatgtcgcctattgagcccgttaaaaagacggtgactaaatgagattttctttaaccatcattcgttgtcaaagtttggaaatgatggttgttttttattgtttaaattaatcattgcgacttctatatcaatgaaagttatcttaatatatgaacttca

SEQ ID NO: 1249 - DNA, 217 bp; double-stranded, linear
ctttcaattacgaacaaatcattactagtttatttaatgataatgactgnaatttagcaaaaaacgtaacatgatcatttagcttgaattggtaaaactgtttatccaacatttccagaccaaatcacaccggtaaaacgtcaaaatatattgtntctatgcccgtttttaccagttatctcattgcaggtatattgatgaattcacaagttggtat

SEQ ID NO: 1250 - DNA, 176 bp; double-stranded, linear
cagaacgtgcggatcgtttttatgcaacctaaaccaggtacggatttagcgtggttaagtggcagtgcactaagtatattcattgatcctgcatttacacgatgaaagcatttattgcatgagtgggtagatgcattttgctggaatgattcacaaatgcattagagnacatttac

SEQ ID NO: 1251 - DNA, 212 bp; double-stranded, linear
tttcaactttctaaattataatatatctttttaaaataagctagaatttctatataataaatgttaataacgaaaagggatgatgcatagtgatcgcaagcacgccagaggccgatttgatattgcgagttagtttatatggtttgggatgatatggatagaattggtaaacatctcctaaagcatggtatagtgcaattnaaaanctgtgt

SEQ ID NO: 1252 - DNA, 131 bp; double-stranded, linear
cagtaagtcaattgaaatggctaatttattaaatctataaaagcatagagcactgttgtgagttcataatcaaagatttataaatgtntcagactgccaatataacatttaggacctagaacattgattat

SEQ ID NO: 1253 - DNA, 462 bp; double-stranded, linear
ttagtagtcatcggtattggtggttcttacttaggtgcacgtgcagcaatcgamatgttaacgtcatcatttagaaacagcaatgaataccctgamattgtatttgttggtaatcacttatcatcaacatatacgaaagagttagttgattatttagcagacaaagatttctctgtaaacgttatttctaaatctggtacaactacagaaccagcagttgcatttagattgttcaaacaattagttgaagaaagatacggtaaagaagaagcacaaaaacgtatatttgcaacaacggataaagaaaaaggngctttaaaacagttggctacaaacgaaggttatgaaacgtttatcgtacctgatgatgtaggtggaagatattctgttttaacagcagtaggattattaccaattgcaacagctggaattaacatcgaagctatgatgattggtgctgca

SEQ ID NO: 1254 - DNA, 400 bp; double-stranded, linear
actcataagtgaatggttgattaccactagttaaaacttcatatactatagtttctttttttattttgcaattagttattttcattataaacttcctttcaaacactgctgaaatagacgtctttttcaaataagcatgattaatacttcaattctttaatccacatatatttaaaagtgaggtagtaggtaataaatataagacttaaagttaagattgcttttttcatgtttcataattaaaacctctgtaaatttaaggttagtattatgaaataatggattggtttattctttagtactaacttcgtagtaaattatatagttcgctaaattgtatttatctactatatttttggaataaacaatttccttttctttcttcagtaaattataaaaa

SEQ ID NO: 1255 - DNA, 137 bp; double-stranded, linear
acaacgcatggatgtgatgcatttaatatttcccgtcgttagtacgacgtttgcagctttnaatctatgtatgggggcatccaaagatttcatagactacttatttgttgatgaagccggacaagcaatcctcaagc

SEQ ID NO: 1256 - DNA, 139 bp; double-stranded, linear
tgaaatgtagaaattgaattagaaatgaagattaaaaatcnacacgtatcgttcaagtggtgcaggtggtcagccgtaaacacaactgactctgcgtacgtattaccatttccactggtgtcattgcaacatcttctga

SEQ ID NO: 1257 - DNA, 177 bp; double-stranded, linear
ttaccanttattttaacaccatgtttagaccaatttgatctgactaaattaatcgctgtttgtacctccaaattgttacaacgtacacctttagtttttctaaattaatgtatattcatcacatcttcttcagttaagggtcaaagtataatttgtcgaaattgtgaagtcgttgta

SEQ ID NO: 1258 - DNA, 250 bp; double-stranded, linear
aagaccaaccgaaatgaatatcgacatggattaagcctatattcagatgtaaacggcgattatattaaaaagccaattacagaatgtagtggttaatgaaatatgcccaagaatgggctgtatcacttaggtgtatcaaactgaccaaaaattggaaggactttaggccaaaaaccatgccaatcttaattacggatttccctggtntgtaatatggccccanattaattccaccatcctttaatttttc

SEQ ID NO: 1259 - DNA, 170 bp; double-stranded, linear
acatttacgggacatttcattacatcaccctgctttattttggattatggcctaatttatactgataaatctaggaggtggaaaaaagaatgccctgcaatttaattncatttaaccaaataatgaaacaataaaaaacattatatcgttacttattaagtaatttggca

SEQ ID NO: 1260 - DNA, 313 bp; double-stranded, linear
tttgtactccgatacgttgtattcaggttgatgacactaggaatttgtaatgatcaatttctctaattctttacaattgatagaattcttcgatttgtggatagacattcatatcattgtctaatgatttttggtgattcataaattgtgactaaagcttggatgctttaggattgtagctgagacacatgttgcgtgactgnggatttatcanataatctcaatcacgtgatccnatcacattcatcagctcactaaatcaagatgatcgtcgtttatgggcgattaatggcgtaccgccagtgtccgcacg

SEQ ID NO: 1261 - DNA, 206 bp; double-stranded, linear
tagcgatcatttaatcaaggttagattatttaatgtcagcattacgtttgacaatgaactgtaaattaggtgaacgttgtctaaagatttatatggtaaggaatcantgcagtgtatccggtttgaggttatcacaatgccatttaacactatgcgcacatggctgaactaatnagcgacgagatgacttcaaaccttgattaggt

SEQ ID NO: 1262 - DNA, 144 bp; double-stranded, linear
aagtgtgtacacgatagctaaactcaaatatcacagaacaacaaatgtcttagtactttgtgccggtggtggtacaagtggattattagccaatgcactaataaagcagctgaagaatatcatntgccagtgaaagcggcactg

SEQ ID NO: 1263 - DNA, 132 bp; double-stranded, linear
ataacgacacctaatgcaatttgaataaagcagtagaatttgtgggaatcgattattgataaccgaactaataatcacagcaaaaataaaattaaaaatgctctaatagtgcctacatnctcctcaaatttt

SEQ ID NO: 1264 - DNA, 159 bp; double-stranded, linear
tatgtcaatttcgtagaattggttttangcgctatttagaatagccatcagataaaatcattatttaaacgtataataggtcaaaatatagagagttactatacaaatttctaactttcacttaaaataaaatatatataattaaagtggaggagaagg

SEQ ID NO: 1265 - DNA, 132 bp; double-stranded, linear
atagctcaagcaatcattatgtttataatgattgtatggttctttatagatgctttattgattaattaataaaaagcttattgcaaaatatgtttttcggtaactgtaatttagtgattttatcattaacag

SEQ ID NO: 1266 - DNA, 405 bp; double-stranded, linear
catggatttatcttagcgattggtctaattttacctttaggtgcacaaaatgtatttatttttaaccaaggagctaatcaaccaaaatatagatatgtattgcctgcaataattacagccgggttgtcagacagcttacttattattattgcagtggtaggagtwtctatcattattatgtctttacctgtacttcawgcawttatttatatagttggtttaattttcttgatgtatatggcttggaccatttggcatgataaaccctcaacagatggagaaactcaaattatgtctccaatgaaacaagtaagttttgctttatcagtttcattactcaatccacatgctattttagatacaattggartaattggtagtagtgctgcattatatagtggcngc

SEQ ID NO: 1267 - DNA, 125 bp; double-stranded, linear
tctttatattgcagtacaaaattcgcgtggaggtttaacacaagtagaccgcacaagatttagcgtctgaaggtattactgtgtaatgcattcgcacctggntatcgttcaaacaccaatgatgg

SEQ ID NO: 1268 - DNA, 247 bp; double-stranded, linear
tttgcccaagtgacgtaaagtacccaatgtccatttgtacttgtatcgccatcaacagtaatcatattaaatgtatggtcagtcgaagattttaataattgatgaagtgtattcgattcaatcgatgcatcgtgttataaaagcaagcatgtagccaattgggaatcaacccgancttggcacacatgtacgttacacattagaacncaagtgaccgacggtaatcctacccgctcaacacaagcgc

SEQ ID NO: 1269 - DNA, 215 bp; double-stranded, linear
tcattgtatatgagcagattggctaggcggtggctggactgacggaatcgacacccggctggggttgggaaaagtacaagacgcaacatgctatgattttcctatgtggttatcgtccgatttaaagtgagcagcgcacggtcagtcatctctcacagnacctaaaaagaacagtaagcncaacctaaagcagtggaacttaaaatcatcaaggt

SEQ ID NO: 1270 - DNA, 119 bp; double-stranded, linear
acaataaagactattaaaagagatataggttagatattacacttttagagcaagacggtataaatgcaagtaaattcgtgtatttatcaatacagcaggtngagtgaaaggcccagcag

SEQ ID NO: 1271 - DNA, 223 bp; double-stranded, linear
cgtggcacgttaagcgtttaaccatagcattaagatgattgtctagcagaggcgatttgcgggctcactacagtgcatgatgaacttaatgcttcaaatgtaacattaaaaataaaagcaacgatgtcacttcttacttctacatctgccatnttcgtgatttcgtatctatcccgcatctcatcttgaacgtacgagcctaatcgcccngcgcgatcctgcc

SEQ ID NO: 1272 - DNA, 120 bp; double-stranded, linear
tagttacaatatctgtcaatttctggagaaccactaaagctatgcataatcccgcctacctcttcagcatgctcctccaataagatatcggtacagtcttgagntgcttcacggttatga

SEQ ID NO: 1273 - DNA, 126 bp; double-stranded, linear
ttgcgcggcagtaaaattcaaactattggcgtcattttgcctagcttaacaaatccgnttttctcagcactgatgcaaagtattcatgaccataaaccatctgatgttgatttatgctggttaaca

SEQ ID NO: 1274 - DNA, 131 bp; double-stranded, linear
gattctgaaggatcaatacnacatgtacaattttggcgtaggtgcaaaggcatcaggtttgcttgctaatctacatcgaagcggctacctaaattaatgagaaatcacactcagttaatgcatgtactagc

SEQ ID NO: 1275 - DNA, 159 bp; double-stranded, linear
tggagtattacctcaagtgaatacaacatacctgttggaagatttttcaaaactttaattggaccaagtgatgccattgatgagttaaatcctaatagattcaggttacctcggatgattgatactaatttggcctggcgcacgctttagtantagtgg

SEQ ID NO: 1276 - DNA, 577 bp; double-stranded, linear
gaagtaaataatatatagaatataacaggaaataaaatagataatattaatgttgtttttttacgcattataactttaaattcgattttcaagtaacttagtatcataattagatcccctttgctttttattgntgaagtatgaatcaacaattgagactttttgtatttcaatatcatccaaattaatatgaagttgttgaagatataaaatcgtatcatttacatttgaagtaataattttsatagtgccattatgattttyyctgaataactaaatcatctttatctagttttaactttcttatatattcatcggataacgtaatctgagattgctgattggttctaatatgtgacgttgaatcattaagtattatttctccattttcaatgagaataattttgtctgacatacgttcgacttcttcaatatagtgcgatgtatagagtatcgttcgattatcttcttttaaattttcaataattgaccaaaaatattctctaatttctatatccatagtcgatgttggttcatctaataagatcaattgtggttgtccgattaaagataatac

SEQ ID NO: 1277 - DNA, 131 bp; double-stranded, linear
ctaaantaaggtaatagttaccaagtaccatatcttgtggatggtgtactacaggtttaccatctttaggttcaagatgttttgatgactgctaacatcaacattcttgcttcagcttgtgcctcttttga

SEQ ID NO: 1278 - DNA, 166 bp; double-stranded, linear
gtttgcgatattttaggcagacaacctaactttacagaaacaggtatcttttctgttatgtggagtgaacattgctcttataaacattctaaaccgtttttaaagaatttcctacgcaggtgccatggtttgggctggagtcaggtgcgttgtgtatagctgatna

SEQ ID NO: 1279 - DNA, 418 bp; double-stranded, linear
cataattatgaaaatgatatgatttttattagaccatttaaaaaagcataatttaaatcgaaggcaggacattgaaatatgaaattttcaactttaagtgaagaagaatttaccaactacaccaaaaagcacttcaaacattatacgcagtctatagaattatataattatagaaataaaataaatcatgaagcacatattgtgggagtgaagaatgataaaaatgaagttatagctgcatgtttattaacagaggcacgaatttttaaattctacaaatatttctactctcatagaggtcctttacttgattatttcgatgctaaattagttgtgttacttttttaaagaattatctaaattcatttataaaaatagaggagtatttattcttgttgatccatatntaatagagaat

SEQ ID NO: 1280 - DNA, 449 bp; double-stranded, linear
gacatatcataaattacatggtgataaaattntcggctacgatactaacggattcccgattacctggttttatccattaggtgaaaagaaagttgaacgtaaggcaccaaaattagaaaaataattaaataaaacagcttaatgatgtaatgaaattagtgagttaatcactgacttctacgtcattgagctgtttttttgtgctttgttacaaagcattattgaatttattttacgtgttcatattttgaaacatcaaagccgtcttgtttagctttgttgataatgtctttgattgaatgtagtcctttatcggcgaagtatgatcttaagttgtcttttgtagcttggtcagcattcttatctaataacacatcaatataacttaattcatgttctaagaagtttgcatcatcatgtagtacgagtccattttgagaataaacttt

SEQ ID NO: 1281 - DNA, 289 bp; double-stranded, linear
tatttatatgtactgatgatgaagtttattatctatcaagtggatcaaatccgaaatataatcagtatatgggtgcatatcatctacaatggcatatgataaaatatgcaaaatcacataatattaataggtataatttttatggaataacaggcgtctttagtaatgaggcggatgattttggtgttcaacaatttaaaaagggttttaatgcacatgttgaagaattaattggtgatttcatccaaccagtaaaacccattccaatattaatntgccaaacctnaat

SEQ ID NO: 1282 - DNA, 402 bp; double-stranded, linear
attcaggtcgaggtggcccggctccatgcaccgcgacgcaacgggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaactaattgatacaacactttctcaacctgatcttctttaccttctacatagcgcgtgagcagaaccatcttgatggcacagctaaataatgcaatgggaatgatgtatgacattcggggtgcataatttctct

SEQ ID NO: 1283 - DNA, 224 bp; double-stranded, linear
tattgacaaccagagtacaaacagcagctatattatagacttaggtctgaagtggtagtggcggtggactattgttgcgactggacacccgagatattgctcagcanagcatcatatacaggaagtattaaaagagacttgncgagtaacaaatactgaagtaataagattaaaagagtgaggtgtataattatcctcgttcttttatattagtatgatagaga

SEQ ID NO: 1284 - DNA, 146 bp; double-stranded, linear
cgtgggagattgtgcatattgattatgcaaggaagnacgccataaaagtggatggccagacatcattaatattattgataccacatcagaaggtattcaaagtgaatcggtgataagtgaatcaattaagtctgccaaagaaaaga

SEQ ID NO: 1285 - DNA, 137 bp; double-stranded, linear
atttcgcgtgactggacttggatccgcaacttggtaatttaaggaattcttgtcattataagccctccatttcatgatttgatttgccactcggtaaccattggggttacagcttcactagggganatacgaacctc

SEQ ID NO: 1286 - DNA, 594 bp; double-stranded, linear
gctattgattatggttagcmtgttgttcwctttactcattgttccttggttaagctcraaaaaagcacgtactttaaagaaacatgcagctaatgaacaggcccgatttttaaatcatttttatgattataaagctggtatggatgaactacgtcgatttaatcaaattaatcattatcgagataatttgatggctaaattaaatcattttgataaattacaacttaaagagcaacgctttttaacgatttatgattttatattaaatattattgctatgctttcgatttttggtagtttagttctaggattaattcaaattaatgcaggccaactaaatattatttatatgacgagtatagttttaatggtcttaactttatttgaacaagctgtaccaatgacaaatgtcgcgtattataaagcggatactgaccaagcattgcacgatattaatgaagtgatatctgtaccttctactaatggaaaaaaacgtcttaatgataagtatgatgcaacgaacatttatgaagttaaggatgctagttttaagtattggaatcagcaaacgtatgtnttgtcggatattnattt

SEQ ID NO: 1287 - DNA, 233 bp; double-stranded, linear
gaggaacaaggcaagtattttgtaagactctcatatgtaaaagtttggaataaagaccgatgaagtagtaataaacccggaaccctaaaactggatggaggatgaaaccaaaaaggaaccagccaagccaaattggggaaaccaggacggcccaatggaggtccaaccaatccaaaccccattccgctaatgnctatgggtcccaattaggaatccaatggatggatggattn

SEQ ID NO: 1288 - DNA, 132 bp; double-stranded, linear
aatccctgtacgttcgtaaagctagctggntaataaaaaagagtctggaaagtaggcaacaatcaatgacaatgagcagatccaatcgcagtatgcttactcgtgtaagaaacgcaaacatggtgcgtcacg

SEQ ID NO: 1289 - DNA, 154 bp; double-stranded, linear
tatctgataattctgtacccaggcgttttaatatgtttatctggtgtcatgatacataaacattgtacctttaggtcatacgatgtcgcaaataactgctcttgccgttacaacaccattacggttatacacttntagccaatcattatctggg

SEQ ID NO: 1290 - DNA, 145 bp; double-stranded, linear
aaaagtggcacatgcggctgtaaagtcctctgtttctgataaatcataacctatatacatgtctaccttccaactcatctaagaaataagtcatatttttttgaatgttggataatcaataaaactcattctcatcatanagcaa

SEQ ID NO: 1291 - DNA, 360 bp; double-stranded, linear
cttaatgctatatattctttgtttttgataccatttcatcgtcttctcttgatttctaaacaatttagaaaataaaagaatatacgcttcagacttattaaaacccgctatatcatcttgatattgtattaacaattgagtaaagctgtgtattaagtcatctttcttcgatgcaatggtagttaatgattttacacgataagcatatttatctgtaaataacttagcaactaccccacctaaatcatgtcctagaatatgtgcctcatgaatatttaacttctccattagaatttttaaatcctcaacgtgatcgtttaaatcgtatgattcacttttagaagacttgccatgacctct

SEQ ID NO: 1292 - DNA, 164 bp; double-stranded, linear
tgtgttagttgtttatgttgttgatatatactgctcgtgcacatggtacccagacgattcaacgntgagtacacaaaatacaaaatctacggcacatggtaccgtttataaaagatgtggaaccttactagcatttgttgagaacgctacacgtttaaatcaag

SEQ ID NO: 1293 - DNA, 132 bp; double-stranded, linear
ttaattttctatatatttcttaggttatattggtatctatgccagtaagtgacatgacgttagatcattgaatccaagatcganacattgggacatatttattaacgacatggcttcaacaggatttggttc

SEQ ID NO: 1294 - DNA, 213 bp; double-stranded, linear
gtcatgcntaacaggtgaatacctagtaattcagatattatcatttatataccctcttatattttagtgcattatctcgaaatcgagatacttaatgtaaatttttagtgcagcctacacttcgtgattgggcantagttcttaaacgctgtggtaagatgttaattcatccttggttaacacacaaacgcttggttaatgctcagcagctag

SEQ ID NO: 1295 - DNA, 163 bp; double-stranded, linear
aagaagtttgaagtctatgaaaacaatcaaaaattgccagtgagacttgtatcatatagtcctgtaccagaagaccatgcctatattcgattcccagtttcagatggcacacagatgaaatgtttctcgnccaatgagagggagaacatagtatcaatagatg

SEQ ID NO: 1296 - DNA, 207 bp; double-stranded, linear
tagctttaatacattctgatttttaaacgcttcgaaatgttttcagtaactaattttgccataatcccaaaaactccttgattattaactgcnttttgattggctacattaaggctttatacacatcagctcaccatgcccatatctactaatggttatatccctagagtcccagcgatataacatcaacgcttacnggagtttcag

SEQ ID NO: 1297 - DNA, 145 bp; double-stranded, linear
atggcatcggttggttatgaaaagncaagccatggggaggccatatttggggtggaatcatacctggaacctttggtgcctaccaccaattggtaacggttttaccatcggatttttagtgatacagcgatatgttttgtacagg

SEQ ID NO: 1298 - DNA, 139 bp; double-stranded, linear
tccaaaagttaaaggtcaattgaaacaganaaagcttattatgtctggaaaagtattaaaagtaatggtatcaaatgacattgaacgtaatcattttgataaggcatgtaatgaagtctttcaagcgttgaattgtggt

SEQ ID NO: 1299 - DNA, 399 bp; double-stranded, linear
gatattggcaaccttcagccgatgacctcatggcaaatgattgggaagttataaacccaactagagaccaggaattattgaagcaattatagaaatgctatcaatgatactttttaaattgtttttaaactcattttcaaagtaaacaacagtcttgtctgaaattgttacatgataaatagtgttactagcatacacgccgtttaggaacccagagtttttaagtttatttaaatcgtattttacatcttcgaaatgtagtttttgaaaatactttgtatgtatatctttagcacttccaaaatttattggcaggttaatttaatcgaacctaactttacacattctaaataatctttgtagagtacggacaagatatattgttggtcttttagtaag

SEQ ID NO: 1300 - DNA, 693 bp; double-stranded, linear
ctacagtgcaatttaaccatgaagttgttgattttgaacaattatcaaatggtcaatgggaagttactgttaaaaatcgcctaactggtgagaaattcaaacaagtaactgactacgtattcatcggtgctggcggtggagcaattccattattacaaaaaacaggtatccctgaaagtaaacatttgggtggattccctatcagtggtcaattcttagcttgtacaaacccacaagttattgaacaacacgatgccaaagtttatggtaaagagccacctggtacaccaccaatgactgtacctcatttagatacgcgttacattgatggtcaaagaacattattatttggaccatttgctaatgttggacctaaattcttgaaaaatggttctaacttagatttattcaagtctgttaaaacatacaacattacaactttattagcagcagcagtnaaaaacttacctttaattaaatactcatttgaccaagtaattatgacaaaagaaggttgtatgaaccacttacgtactttctatccagaagcacgtaatgaagattggcaattatacactgctggtaaacgtgtacaagttatcaaagatacacctgaacacggtaaaggattcatccaattcggtacagaagtggttaactcacaagaccacactgnaattgcattattaggtg

SEQ ID NO: 1301 - DNA, 471 bp; double-stranded, linear
catacttgggtaatgctgcccatggnacgctggnacaaggtaaagttgcacgtttaatttgtgnatgtatataaaacagatgggaacaccatttgaaggggatcctcgtgcaaacttaaaacgtgtattaaaagaaatggaagatttaggcttcacagactttaacctaggacctgaaccagaattcttcttgtttaagttggatgaaaaaggggaaccaactttagaacttaatgatgatggtggatatttcgatttagcacctacagatttaggtgaaaactgtcgtcgtgatattgttttagaattagaggatatgggcttcgatattgaagctagtcaccatgaagttgcccctggtcaacatgaaattgacttaaatatgcagatgctgttacagcatgtgataatatccaaacatttaaattggttgttaaaacaatcgcacgtaaacataatttacacgcaaca

SEQ ID NO: 1302 - DNA, 400 bp; double-stranded, linear
catgtgattaagaacgttcactgatgaatttttgatgatcgttcggtttttgtttggattttaatgattatttatacaaaaacagccgtatttcaagccgtacattttaaatttaactaaatttgcatctagttaataattgcatttatcaaatttgtcttattgatccaatctaatttgtactcacaaactagtttraaattctaactttatctctcagttcgttatcaatcatcagacataaaccaatgaagcaatcagaaaacactctaattttctattagaaatttgntttaatataaaaaaacaggcttacttcatataatttatgaaataaacccgtcaatttttgtttaatatgcttggtgatctnttattctgcgtaataatgctaaacctg

SEQ ID NO: 1303 - DNA, 128 bp; double-stranded, linear
aaaagcttagttgaactttcaacgtatcttagctactgaaggtgcagaagttttagaagcaaaagactggggtaaactncgcctagcttatgaaatcaatggatttcaaagatgggctctacaacatc

SEQ ID NO: 1304 - DNA, 141 bp; double-stranded, linear
tccttcggattctaaatggcattggacagtgtttacaagctcgcatttctccactttttgcaatttcttttacaatttctaaagcttcatcaaagtttccttcaatagnaaacgatttctgcaccatacattactgacttg

SEQ ID NO: 1305 - DNA, 162 bp; double-stranded, linear
gactggtaaacactaagtgaattagctggacaatgaaaaatatccacaatcattaattaacgtacgcgtaacagataatatcggttgaagaaatgttgacgttaagagttatgactaantagagtagaatgatggtgaggtcgattttagtagactctggac

SEQ ID NO: 1306 - DNA, 282 bp; double-stranded, linear
ttcttagttgctcgaactaataatttgcttaataatgatstagctgttattgtgtcatattctaaaggtgccataaatttaaaaactatagtagttgttttaaatttagttgttggtgaaactttgatatgtatatttggttgagattgtctactcaaatatatagcctcctctatatcttcttacatctatatttttctagtgattttaaattgaactaagctatttttcatataatttaatgaatacaaaataggttcatctgattcattatagtgcgta

SEQ ID NO: 1307 - DNA, 276 bp; double-stranded, linear
ggttgcccggttttttggnaaggttccttgggggttggaaaaattggggttcccgcccaaaaggaaaaaacccttggcctttggaaaaaacccaaaaggaaaggggtttaaaaaaaaaaaaagtttaacccggttggccccaattcccgcccggggaacccaaaagganttttaaaaaaggaaacccaattcccggccggaaaagggtttttaagcccaaccggattttaaggaaaaccattttaagattacctgggaaaaaaaaccgtttaggaa

SEQ ID NO: 1308 - DNA, 692 bp; double-stranded, linear
tgtatttaatgctcgtacacacaattacaaaactgcaagagaaaaagcattgagtaataatcatattccagaaaatgtatatgacaatctagtaaaaactgtacataaatatttaccattgctacatagatatactgaattgcgcaaagaattgctaggtttagatgacttgaaaatgtatgatttatatacaccattaattaaagatattaagtttgaaatgccttatgaagaagctaaagagtggatgttaaaagcattagaaccaatgggtgaagaatatttaaatgtagttaaagaaggcttaracaatcgttgggtcgatgtctatgagaataaaggtaaacgttcaggtggctattcatcaggtgcacatttaactaatccatttattctacttaactggtctaatactatttcagacttatacacattagttcatgaatttgggcattcagcacatagttacttcagtagaaaattccaaccgtcaaattctagtgactacactatttttgtcgctgaagttgcatcaacttgtaacgaagcacttttaagtgattatatggataaacatcttgatgatgaaaaacgcttattattattaaaccaagaattagancgtttcagagctacattattccgacaaacaatgttcgcagaatttgagcataanattcatgcaattgaag

SEQ ID NO: 1309 - DNA, 151 bp; double-stranded, linear
ggactattcgatgatagcttttttgactggatttactaaaatgaaagcaagtactatataacaaaatccctctttagagtgtacattttacaatgtgtacttcaaagagggattgttattatcgagtaatatctatatatgacattttaaa

SEQ ID NO: 1310 - DNA, 115 bp; double-stranded, linear
tgtgcatttgataatattcactatgattcgtggtcattcacatcgtctacgctcaccggtctaaacgtacctaacccaacatgtaatgaacaaatgcgatattancacctttatt

SEQ ID NO: 1311 - DNA, 164 bp; double-stranded, linear
cacccaactgacctcaatggtataatgcatttgtgaataccgaatatcattggaatatctcctatcataggaatataatatgtatatatcttcgtaatcntgttcatttttaagaaaatcaatagaagtgtatcgattaaaactacatttgaaccattactttg

SEQ ID NO: 1312 - DNA, 141 bp; double-stranded, linear
gaggaaaatcgaagtgaaattattaaaatatggcgatggtggaatacgaatagatggtggtttaataggcggctttattcgggtgttattgtatgtaaagtgaaaaatttaancccatttcaaattggtgatatcgttgcg

SEQ ID NO: 1313 - DNA, 133 bp; double-stranded, linear
aattggtattatgcatagtgcaatggatgctggtattaaantccagaggattacaattattagtttcaataatcacgattagttgagatggttagccacaactttctagtgtatcaccattatatgtatcggt

SEQ ID NO: 1314 - DNA, 629 bp; double-stranded, linear
ttgcaattagaatgctgtttcacccctttaaaccatactatatatttaaatttagagtcccatttacaccaggtttaataccgaaaagacgcgaagaaattgcaactaaaattggccaagtgattgaagagcatttgcttacagaaactttaattaatgaaaaattgaaaagcgagcaatcacagcaagcaatagaatctatgattcaacagcagttacaaaagttgacgaaagatcaattgtcaataaaacaaattacttctcaaatcgtattgatttagaacaagtattacaaactaatggaaatcaatatattgaatcacaattgaataattattatacaaagcatcaaaaccaaacaatagcatctttattgccaaatcaacttgtaacatttttaaatcagcatgtagataacgcaacagacttattatgtgatcgtgcaaggaattatttatcatctgcaaaaggcacacaagatattaatgatatgttggatacttttttcaatgagaaaggtaagttaattggtatgttgcaaatgtttatgacaaaagagagtattgcagatcgcattcaacaagaacttatacgtttaacatctcatcctaaagcaagaacaattgtga

SEQ ID NO: 1315 - DNA, 399 bp; double-stranded, linear
aaagaaacaggagaagttaaagaacaagaagtctttatgggtgtttcccattaatgactgatacaggtacgttcgttatcaatggtgcagaacgtgtaatcgtatctcaattagttcgttcaccatccgtttatttcaatgaaaaaatcgacaaaaatggtcgtgaaaactatgatgcaacaattattccaaaccgtggtgcatggttagaatatgaaacagatgctaaagatgttgtatacgtacgtattgatagaacacgtaaactaccattaacagtattgttacgtgcattagggttctcaagcgacccaagaaattgntgacctttaaggggaccaatggaatatntaccgtaatacctttaggaggaaagaccggcacctgaaaccactggaa

SEQ ID NO: 1316 - DNA, 778 bp; double-stranded, linear
ataaacattttaanatgtaattnagaaatttttttagtacaaaatctttcttaataatgattaaggaggtcagtaatgattgaaattaaaacattaacgaataatgattttaatgagtataagagacttgtttcgacagtcaatgaagaattcactcaagattcacattatagtcaaacaatgactgacaccttaatacatgacattttaaatcaaggttcaccgaaatgtattgtatttggctgttatgaaaacgaaacacttatcgcaacagctgccttagaacaaattcgatacgttggaaaagaacataaatcattaattaaatacaactttgttactaataacgataaatcgattaatagcgagctcattaatttcattattaattatgcacggcagaacaattacgaatctttacttacatcaattgtgtcaaacaacatagnngctaaagttttctatagtgcactaggattcgacattcttggttttgagaaaaatgcaattaaaatcggaaatacctatttcgatgaacattggcttttttatgatttgattaataagtaatacagttttatatattctacrtttctcataaattcaaatcatataggttctatttttcatacaactactctactattgagtagttgttttttatttgatatgataacaataagtttttttcagaatattctatgttttaggggtgtcaaaacttaatgggtaaccgcaattattcatgganttatcntaagcgattgggtcctaantt

SEQ ID NO: 1317 - DNA, 465 bp; double-stranded, linear
tgcacaaggtggtgcagcaattgcagcgttctttattattaaacaaaataagaagttaaaaggtgtggcatctgccgcagtattttcagcattacttggtattacagaaccggctatgtttggtgttacttaaaactaagatatccatttattggcgctatcgttggatcaggtattggttcagcatatattgctttcttcaaggttaaagcaatcgcattaggaactgctggattgccaggatttatttcaatcaatccagtacatgcaggatggttacactactttgttggtatgacaatatcattcatcattgctataacagttactttaattttatctaaaagaaaagcaaataaagaagttgtagaataaaaaaagaggtatgacagtaatcaaagtatcagtcattgcaaatgcaataggatgaaactttaagctgtcatacctttnaatttagttata

SEQ ID NO: 1318 - DNA, 150 bp; double-stranded, linear
gacttaatataactgatcttttgctattattgaaacatatttataaagaaaatagcattgcataatacccaagcaataaatactataatattttggaagtaactaatcaaacatctaagacatgattgatancaccacagaaaaataaga

SEQ ID NO: 1319 - DNA, 131 bp; double-stranded, linear
ccaccttttaacgtacgtatccatgaatcatatgattaatttaatatcattattacttatttcttatctttattntctttttttcttctgaaaagtagtaatgaacctattgatgctaataatccccaaat

SEQ ID NO: 1320 - DNA, 140 bp; double-stranded, linear
tagtgtccaaatgaaagtgtggctacctatagctggtccatgaagctttatttttaactggtttgtacaatatttaaatatcaaaatcttctcgcgntttggacagtttttttggtattaaccattaataaacggaaaga

SEQ ID NO: 1321 - DNA, 140 bp; double-stranded, linear
cttattatataattctaatcctagtacattatacattttatcaaatagtcaactggataactttgaaagtgaatgatncttttaaaataaagaagataatataaagtgcttgataatggatttgtagttgatgatttaaa

SEQ ID NO: 1322 - DNA, 185 bp; double-stranded, linear
tcgttgcaacacaggcactattttacctttatatgttgtaatagtttgattgctgccatttaaacaaccacctttcttactccacaaatttaccatgaatagcgcgcgcgccatagcgggatactaaagtgttctgcaccttgcctgtctccttcaantttcgattactgtagagcacaagtacg

SEQ ID NO: 1323 - DNA, 148 bp; double-stranded, linear
acctgcaattttcgttattcaaaacaataactatgcaatttcaacaccacggagcaagcaaactgctgctgaaacattagctcaaaaagcaattgctgtaggtattcctgggtatcccaagttggtggtatggtgcggtanttggttt

SEQ ID NO: 1324 - DNA, 141 bp; double-stranded, linear
gaaagcattgatggacaaagatgaaccaccaaatgaatggcgattagattccaattgatatggctcacggaaaatttatgctacaattgcgtccagtaaacagtggcactaatagtccacttangctccctagtggatgaa

SEQ ID NO: 1325 - DNA, 204 bp; double-stranded, linear
ttatactatcgtgaagggtttattactcaattaatgcctaaaaaggataaaagttatttagttattgataattttaatcgtatagatacagacattttccaaacgtatattaatgtgttagaaggctatgaagtaacattaccacgttataataaagacggtaatatgattaaatggtcacgacaaaaagattctttctattat

SEQ ID NO: 1326 - DNA, 147 bp; double-stranded, linear
acataccgcttgcacttggcaagtttgaccgnaaatgactttgcagctatgcatttgttctttgttaaaagtcttcatttcggatgaagctttatctattgaacgctccaaattatttaaagcagctttttctttattaacagctgt

SEQ ID NO: 1327 - DNA, 530 bp; double-stranded, linear
cattnaatgaagaaactgaacccngaactatacgacgcagaaggcaatttaattaataatagtaaaacatccagcttaatccattgatgtgttataaaagtgaaaagctccaatcaaagttgacgctcaaatagtttaactttgatcggagcttttttataatgtataccgaaaggttcaaatattatataatggtagaattgaaagagaatataaaaaagtgaggatataaaatgaaagttaatcctaataatatagaattaatcattagtgcagtaaaagaagaacaatatccagaaacagaattgtctgaagtgcactgagcggtcgatctaatgtaggtaagtctacatttatccaatagtatgattggcagaaaaaatatggcacgtacatcacagcaacccggcaaaacgcaaacgttaaatttttataatatagatgaacaacttatttttgtggatgttccagggtatggatatgctaaagtaagtaaaacacaacgtgaaaaatttgggaaaatgattgag

SEQ ID NO: 1328 - DNA, 153 bp; double-stranded, linear
aagaaagtttgatctaggccaacctttctaacaacgatacgacagtttaataatgtctcatatcttgacttcccatgatgatatggtcgttaatcacatcaatgacttaaatctggatnaatagatgcgaatggatcttgaaaaatcattgta

SEQ ID NO: 1329 - DNA, 115 bp; double-stranded, linear
tgtagttcgtttgtgctctaattaaacggtcgaaaccatggattagacctgcgattacaactgcaatgatacctgaagcatgaacttcttctgntaaaaagtatacgacaaaagg

SEQ ID NO: 1330 - DNA, 112 bp; double-stranded, linear
aacaagttatctacatctgctgataggcatactattactaataaataatgcatctttttgccagatgttttcttaatcaattgcaccaacgaatggcactctcatctgtagn

SEQ ID NO: 1331 - DNA, 203 bp; double-stranded, linear
ttcattgcagacanttggtgaaccatgtggacgaactagtcctagattaagataagagattagtgancattgccaccactgcaattaaacattcttggaaaaattaacttaagttagaatcttaatgcatacagatacggcgaagatgatgccaaagaacgtcacgactttatgatgatgactgaacccagtttttacggaag

SEQ ID NO: 1332 - DNA, 269 bp; double-stranded, linear
atgatgtactaatatctaataagcttgctaagtcttgagacctcattttaatcaccttttgaggtgaatttagtataaatttagctatctttttttcatttttagtcatatatggatattgactatctatttctgttagtacgtttgacatattaatcactccacyttaacgcaatawawtttawtagcgttggctattgttgtttaacgcgatggnatttacaacttgtaacgtaagagaatgaaaaataagctgnatatgttgtttg

SEQ ID NO: 1333 - DNA, 142 bp; double-stranded, linear
tagcttttgcccaatatggtgaatcatgcgccgttctgtaataatcttcacttggcattcttggaatttgaacaacatcctgttcatttttatagantgcttaaatggtacagctgaaaaatcaaagtaatgtccttttctg

SEQ ID NO: 1334 - DNA, 211 bp; double-stranded, linear
actgatgcccaatatgcatcttgncaattgcaggtgtgcatgactaaacacatgacaaatctgcctgactttttgctgacccataaataattggnctaactttttgcatcttgatcttgcatccttgccttcctatttaaaatgctacaaataaatttgccggcgagtgaattttaatgttttacaacgctgttcaatacctgggaataag

SEQ ID NO: 1335 - DNA, 129 bp; double-stranded, linear
cttgaatctcttgtgcctctgtgatgtatcatcaaattatttgcactgcttcttcttttatcgctgcttgttgtgcttcaagccacgctttgattcttatntgatacagccacacttttatccgctcgc

SEQ ID NO: 1336 - DNA, 633 bp; double-stranded, linear
catgatggcntcttaccaaaggcgattttaagagcaatgataccaagatatttttaatactgatcaaagttcaggtggtagcacaattacacaacaacttgttaaaaatcaagttcttaccaacgaaaaaacatatagtagaaaagcaaatgaatncgcctagcaattagattagaacacctactctcaaaagatgaaattatatatacatatttaaatatagttccttcggtagagattataatggcgctaatatttccggaattgcatccgcttcatatagtctatttggtattccaccaaaagatttatcaattgcacaatctgcataccttatcggtttgttgcaaagcccatatggctatacaccctacgaaaaagatggaacgttaaaatcggataaagatttgaaatatagtattcaaagacaacattatgtattaaagcgtatgttaatcgaagatcaaatcactgaaaaagaatacaacgacgcattaaaatatgatattaaatcacatttgttaaatcgaaaaaagcgttaattgatgctcactttttaaagtaaccacaacaatgaatccaaatattaaaaacagcagtaagattattttcaattagaaaatttctcactgc

SEQ ID NO: 1337 - DNA, 317 bp; double-stranded, linear
atcaatatttagcagttatcattatgcttgaacgggtggtaaaggcggagaagtcatccactttttcctatactacaaggacctttactttaaaacaacgaatttacaaaataaaaggcataatttcttttctgtcacatcgctcattctaactactagacttttaaaatcgttcctgtaatttaaactcaatcaactntcaattaatgatgcataatatgattataagtatagtagttaacttcaaatatcttagaaatgtcctgtactatatctcttttattctcaaaagtcataggtaataaagcctttccttt

SEQ ID NO: 1338 - DNA, 125 bp; double-stranded, linear
tacggcatatacctcgttcatcaatgttcgtaaacattatttaaaacatctcttacatcttgcgttggaagttcttcatagtcgaatttcattgtnttatcaaagttttccatttgcgacactcc

SEQ ID NO: 1339 - DNA, 111 bp; double-stranded, linear
gagcttcgttccattgttatcaaacgattgccattctgaaatgctgtaaatagcatgcttcaaatcatcttgtgcctgcagcagtttctttgnaatatgcttcatatcatt

SEQ ID NO: 1340 - DNA, 158 bp; double-stranded, linear
tcacacgtttagttttctatgaataccaatattttaacaccatgtttagccaatttgtctgctaaattaatcgtgtttgtcctccaaattgacacgcacctttagtttttctaaataatgatatcatcacatctctcagttaaaggtcaaanatattg

SEQ ID NO: 1341 - DNA, 400 bp; double-stranded, linear
gcttcaggtcaattaaaacgttcaagagctttcacatctcacttattcgcaaacaagagcactaaacaaaaacgtcaattacgtaaagctagattagtgtctaagagcgatatgaaacgtgtaaaacaattattagcatacaaaaaataagaacaaatacagaaatcggtaggaattacctaaggaggaattttttatgccacgagttaaaggtggaacagtaacaagagcgcgtcgtaaaaaaacgattaaattagctaaaggttacttcggttcaaaacatacattatacaaagtagctaagcaacaagtaatgaaatcaggtcaatatgctttccgtgaccgtcgtcaacgtaaacgtgacttccgtaaattatggattacacgtatcaacgcagca

SEQ ID NO: 1342 - DNA, 400 bp; double-stranded, linear
gttgaacaagggcaacaaaaatttcgagcgaaacagatttttgaatggttatatcaaaaaagagtagattcgattgatgaaatgacgaacttatcgaaagacttacgacagcttttaaaagataactttactgttacaactttaacaactgtagtaaaacaagaaagtaaagacggtacaattaaattcttatttgaattacaagatggctatacaattgaaactgttttaatgagacatgattatggaaattcagtatgtgtaacgacacaagtaggttgtcgcatcggatgtacgttttgtgcttctacacttggcggcttaaaaagaaaccttgaagctggcgaaattgtttcacaagttttaacagttcaaaaagcccttgatgctacagaagagc

SEQ ID NO: 1343 - DNA, 399 bp; double-stranded, linear
gaaaatttcatcaggtgttggcgtggaacgtacattcccattacacacaccaaaaattgaaaaaatcgaagttaaacgtcgtggtaaagtacgtcgtgctaaattatattacttacgtagtttacgtggtaaagctgctagaatccaagaaattcgttaatcagcatttaaacaaagctatgtatgagtcaaattcgactcaaacaataaagccatctaggtcacttttatggagtgatatagatggctttttttgctgtttagttaatgtaaagttgataatgtaattgtttattccttctctattcataacgtgtttgctcaaaatggttatataaacaaaaatctactaagtgccattgaaaaggacttagtagatttattaaatatatgcgtana

SEQ ID NO: 1344 - DNA, 134 bp; double-stranded, linear
aacttacaacaccaggtaataacagcaataaaggcaccagttagtgcggtaatgccantatctaggcctttaggttgccatagtacgagatgtagaggtactagaggaatgagtgtcgctaaagttgtcgtcgt

SEQ ID NO: 1345 - DNA, 109 bp; double-stranded, linear
tcataataaacaagttcacatgaatcacaacatctgaagacaatgttcaaaatgaggctggcacaatagatgatcgcaagtcgnatcatcacacagtactgaagcaaga

SEQ ID NO: 1346 - DNA, 113 bp; double-stranded, linear
ccatatctggnacgaccgacacctttaccaccaacgattggtgccatttgtttgcataagatcaccggctttaacgttatttgttaaagatttagggacagttgcaaccatcg

SEQ ID NO: 1347 - DNA, 124 bp; double-stranded, linear
caattgaaaggtgaattttataggtccatgacaaactaaggcttgttaaagcttattaacacagtttcatcaaatagttaaattagtttttgttttgcaataaattgggtatagattacaantg

SEQ ID NO: 1348 - DNA, 337 bp; double-stranded, linear
catcagtggcctgatcaccccaacatttgacatcaatgcataccagttgatttgaacaatgattgcattgagctatcatcaagtttgtctttaagctactaaacccacgaaccatgttaaccccgtggtcaccatcaccaattgctcgatctaattcagttaattcagattcatgttttttaaacgtttcttctaaatttaataaacgtgctttcatatcatcatttcattgtgcactataaatgtatattattcatattcacttctnatttaaagtatgacttgttgttggtgctaaaaatgcntccaaatattctggtttatnaggcacgatagt

SEQ ID NO: 1349 - DNA, 162 bp; double-stranded, linear
cagcacgtaaatacaacaaagcgatccccagcttgtggcacatcattaatacctgtaatttcaacaggcgttgatggaccagccgttttgattctttgacctaagtcattacatgccgaaggcgtagatacacaatnctacacttagagttgatatagggag

SEQ ID NO: 1350 - DNA, 399 bp; double-stranded, linear
caattttactttgaatttcttttttatcttttctagttttatcgtcccactcttcaatccattttttagctttatcttcattattagtcaacttgcctatttcttttaatattctttatgattgtatttattgtatgtatatgggattgttggcgctattttttggtatttttttatatttttatccatagcatctacaacaattaaatctggttttgctttagcaactctttcaacatcattttctccaatataatcaaccccttttaaataaggttttaaaattgaagaatctttagttatatctgaaacagcaattggtttgattcctaactttataaaatcaccaacataaaatccagttaatacagcaactcttttaaggttctcngggacttt

SEQ ID NO: 1351 - DNA, 400 bp; double-stranded, linear
taaaacttaggcggttttgcatgattatagcgctcaacacgtttgaaattataggtcatctctggtattcttgtacgattctttttccaatctaaatcaaagttttcaatttcttcttttgagtttagacttaatcgatcacgttcatgttctttaaaagatggaataacttgtttaagtgacccttccattcttaattgaccatgtgaaaaccaagctatgtagttactcacttgtgaaattttatcaatatcatcaccaattgacacaatcgttaaattattttcaatataatcatttgttaattcaatcgcacgttccataaattgtggtgttaaatagtcaataacatgatttaaaataataatatttgattttgatgagcgtgcaatacttaata

SEQ ID NO: 1352 - DNA, 117 bp; double-stranded, linear
aagggaacaaaagctggagctccaccgcggtgcggccgctctagaactagtggatcccccgggctgcaggaattcggcacgagcatatctagtattttaggacggaggnagtacatt

SEQ ID NO: 1353 - DNA, 153 bp; double-stranded, linear
agttcaggagagttataaatattagggtggtacatgcccgaaatcattggaattgttaaagtagattttacagtttagagataacagacatgtctatatgaagggctgtctaccctcgtaaggttatatcctacagntgaacgtatcaagctt

SEQ ID NO: 1354 - DNA, 159 bp; double-stranded, linear
tgttgtaacagctctctatgtttacgttggaagtatggtttatttttcatcttcacatttagttccttatttaaaagtgatagagcaattgcactcgtaggtcaagaagcgggatgccaacacaaagttcacaaganaatacacttttgaaaatattgg

SEQ ID NO: 1355 - DNA, 118 bp; double-stranded, linear
cgncttccttcaaccattgtagaagttgtctcatatacttactacggcttgctaatactcaatactcaattgataagttgcatatgccccttcaatcttgaagttgcatatgcttcct

SEQ ID NO: 1356 - DNA, 110 bp; double-stranded, linear
ggattcattggtgcttatttatttacattcaataatgaganctttacacaaccaattggtcaaattatagatgtcaacatgtttcttcgacacctacaaaagatgcacaa

SEQ ID NO: 1357 - DNA, 133 bp; double-stranded, linear
taatggtggggtatatttatattagtaccgaattttaggngcctcactatcatttatcaaattatttaaagtgggatcctatcgcaatcaattggcaggggcagaataatggcattagtcgttgaagatatcg

SEQ ID NO: 1358 - DNA, 400 bp; double-stranded, linear
gtgtcggtaagtccactttcttaaatcattatcgtccagaacttaatcttgagacaaatgatatatcaaaatcattaaatcgaggaaagcatactacaagacatgtcgaactattcgaacgtcaaaacggttatattgcagacacacctggattcagtgctttagattttgatcatatagataaagatgaaataaaagattattttcttgaattaaatcgatatggtgaacatgtaagtttaggaattgtaatcatatcaaagaacctaattgtaatgttaagcatcaattagagatagggaatattgcgcaatttagatacgaccattatttacaactatttaatgaaatttccaaatangangggttagatattanatgaccaaacctatatccatca

SEQ ID NO: 1359 - DNA, 392 bp; double-stranded, linear
ctgttttagtcttattgattgcctgaccattaactaagtaatttgtgtttgaagcggttaattgagcaatgattggaatgtcgtatttctttctcgttcgtgaaatgacatttgttaactcttctaggtcgtaatacgtttcgaaaagtagcgcgtcaacgccttcttcaattaaggtgtctatttgaattcagtatgataaagaatagtttgtaagctgatatccccctgtttggatacctctaaaccccaccaactggggcccaatatatacgtaanctntaattggcnggcttttttgcgatgcgacggggggctggaggatgcttaaccttaacctccagaccgaaccgtttaacctttccaaaattgcaccataggaatgggtggat

SEQ ID NO: 1360 - DNA, 160 bp; double-stranded, linear
ccatggttattttcttcacatttcatgtatatatatttgtttattatctgtctctactagactgtaacctccaacatatctgttttataaaccagagagcagtcattcaataaataaacagatctgagggccaactggcatgttgtcaacttatgatatt

SEQ ID NO: 1361 - DNA, 148 bp; double-stranded, linear
gtatcctaaagattcagttaatcggagcgttgtattgcatgaaggtacattgcggaatgcaacagcgaggtaaacattacggaacgatgcctttatatttaatctctttcgggaaaggacatatttattcacgatnttatttagcgac

SEQ ID NO: 1362 - DNA, 147 bp; double-stranded, linear
aaaattactatgaagattgcattaggatgcgaccatattgttacagatacaaaaatgcgtgtatctgaatttttaaaatcaaaaggacatgaagtcattgactgacacttcactcatnagtggcgacagtgtacgtatcagacttag

SEQ ID NO: 1363 - DNA, 108 bp; double-stranded, linear
ctggcaaagaagacaacaacaagctggtaaagaagcaacaacaagcctggtaaagagacaacaacaanctggcaaagaagacggcaacaagctggtaaagaagcaaca

SEQ ID NO: 1364 - DNA, 153 bp; double-stranded, linear
gacaatgttgctgtaatggggaaggnaatgggttggtaccgcgaattgaataatttaaaaccgtaatatataatcgtaattgttaagccctcatttttataaattttggacctcttgaaaaagttacgttttcaagaggttttatttatccta

SEQ ID NO: 1365 - DNA, 184 bp; double-stranded, linear
taagagaattatatgcattccaaacgaaacnaacagaaaaacggaccaaactaactgtcacaagtacaatcgctgtactactgcaaaacacgcaaaacgaacacttacgtacacacaaaaagaccaccattcacgtcgggattattaaaaaggtagtctcgtacatttattaaactacttacgt

SEQ ID NO: 1366 - DNA, 452 bp; double-stranded, linear
acattagatgggtcaatcatgttatacacggtgatttaggggagtcaatcaaatataaaaggccggtaattgatgttattgaggaaagaattccaaatacaatattactcggtgctatgtcattaattattacttatattatctcatttgctttaggaataacgtcaggtagatattcttacagtttgacggattatactgtgcaaatatttaattatttgatgttagccattccatcttttattgcgggagtatttgcaatttntattttttcttttgaattacaatggttcccgtttcaaggttctgttgatattaaccttaaagaaggtacttttgaatattatatgagtaaaatatatcacacatttttacctgcattcactttaggtttattatctactgctggttatawtcaatatttacgtaatgatattattgaaaattctaaa

SEQ ID NO: 1367 - DNA, 141 bp; double-stranded, linear
ttgtgagtaattggacaatataagtgttggtcttggatggcatatccttggtacgacctgggcaacttgcttcatagcgcagttaggaactgatcaatcattggcgttttgatacctagcattttcccaatatgctgantc

SEQ ID NO: 1368 - DNA, 126 bp; double-stranded, linear
tggtgcaaattaaaacggttgcatatgcacgtacgacgtattgctaaatacaatcaattattacgtatcgaagatgaattatttgaaacgctaaatatgacggtatcaaatcattctatnacttag

SEQ ID NO: 1369 - DNA, 160 bp; double-stranded, linear
tgnaaagttcatcagggagccatttttacaacacagggcacatacgggttgtgtttaggtgcaattgccccaagcggacaaagcattatttaaagtttcaagttcttcaacgatttattagtgcacaggatcctgttaagaggtattttgaagacttccg

SEQ ID NO: 1370 - DNA, 400 bp; double-stranded, linear
agtaattctgcaaatgccgcagatagcngtactttgaattatgaggtttacaaatacaataccaatgacacgtcaattgctaatgactattttaataaaccggcaaagtacattaagaaaaatggtaaattgtatgttcaaataactgtcaaccacagtcattggattactggaatgagtatcgaaggacataaagaaaatattattagtaaaaacactgccaaagatgaacgcacttctgaatttgaagtaagtaagttgaacggtaaaatagatggaaaaattgacgtttatatcgatgaaaaagtaaatggaaagccattcaaatatgaccatcattacaacattacatatanatttaatggaccanctgatgtagcaggtgctaatgcaccaggta

SEQ ID NO: 1371 - DNA, 345 bp; double-stranded, linear
catcaagaacatgtgagaccacaatttgaatcacttgaaaaaataaataaagacattgttggatggataaaattatcaggaacatcattaaattatccagtactacaaggtaagacaaatcacgattatttaaatttagattttgagcgagaacatcgacgtaaaggtagtattttyatggattttagaaatgaattgaagaatttnaatcataatactattttatacgggcaccatgtcggtgataatacgatgtttgatgtgttagaagattatttaaagcaatcgttttatgaaaaacacaagataattgantttggcaataaatatggtaatctccattgc

SEQ ID NO: 1372 - DNA, 154 bp; double-stranded, linear
ttgaaaagcagtttggatttatgctcaaaccatggacgacggttaggtttatgaatgttattccaaataggttcatctataaaaactagtggaaagtggaaaaaatnagtggaccttcgataatacgatgtatttatcgttagaagcagtaata

SEQ ID NO: 1373 - DNA, 136 bp; double-stranded, linear
gagcctaattattcaagccaaatcgcatatgaaattgataaagaagttcaacgaatcgttaaagaacaatacgaacgttgtaaacaaattttattagagccaaaacatatttattgcgaactatacnagaactatc

SEQ ID NO: 1374 - DNA, 358 bp; double-stranded, linear
atctttaacaattaaaaccatactatcttgaatcatcatcaaatttaacgcatgtgcgtcaagttgtttcactttaaagacttcattattaagaccgaccttagactgctttttaaaaataggtacattcgtaatcatacctatactttgattgtctaagtgtaatttgttttggtgatatcgattataatcttgtgcagtaaaagctgtaatcattactgattgtcttgaaaatatcgcgccttcattaccaatgaagtctattggaatatcatcactagcctgttttaacttgtaataagcacgattctnttctaaagaagctctaaataatgtcgtttcatatactttgaagtct

SEQ ID NO: 1375 - DNA, 122 bp; double-stranded, linear
atattgtgtgctaaatttgcttaagtatgttttttgtttgnaagtaagcatatgttattgtctttttaattgttgtaaaagtgctgttttcatagaattaatatcagacatctttattagta

SEQ ID NO: 1376 - DNA, 467 bp; double-stranded, linear
cattttcttcggtttctgtctttttatgcgtagatttattttcttgttcttggttattacttgatgatgtagaatgatttattgcagcataaattgcgaacccaagtgctccgattaatacgataattacgatggtaataagaagttttttcaaatataacgcctccatgttaatgaaaagtagttgatacgtgaagctaaataattnatttcaatattgccataatcattttaaaaaataaatattagaaaagtaggcgatattaatattttcattgttttttgtgtacttcaattagtataacaaaactgttatgtatttataaatataatcattagtatttttatggctgaaaaagttataataaaagtgtaaggaataaaatatttgtatggaaaagagagataattatgaataaaaccagtaaagtttgtgtagcagcaacattagcattgggcacactgat

SEQ ID NO: 1377 - DNA, 128 bp; double-stranded, linear
aggtgttagaatttattttaagtgttatacgtgtcttccagaaattgtaatggcattatatttatnaaagtgttggcaggttattttcaggtgtattagtttaggtatcattcgtagtatgcttggga

SEQ ID NO: 1378 - DNA, 400 bp; double-stranded, linear
ggacgctagaggatcccggtctggaaaatatcgtccagaacttagaaatatgaaaatattcccaagaccaatcgataatatattgccaatatggcgtgctgttggtggtccacctgcaagtgctattaaagcgggaaaacaaggtgtgccaatgatgattacaacccttggtggcccagcaatgaactttaaaggttctatakatgcttatcgtcaakcggcaactgaagcaggtttcgatgcttcgcctaagtctttaccagtaagtacagcgagtctgttttatacagctgaaacaactcaggatgctatgagagaattttatccacatttgaatacagggatgtcatttattcgtggtngttggttatccgaaacagcaatngctaattcgtcagtt

SEQ ID NO: 1379 - DNA, 108 bp; double-stranded, linear
aactacaacaatttaacgaccaaccttaaaanaatacgctcttatgcattggattagtcctgattatacaatttaactgaacaaatacccatcatttaaaagacttag

SEQ ID NO: 1380 - DNA, 118 bp; double-stranded, linear
aagtggggggaatcagtatgttacatttacatatattaagtattagcgattattttatttatcgctacatacttaaccatttcaaaaattcaaggcggntcaccattttccaacccgt

SEQ ID NO: 1381 - DNA, 114 bp; double-stranded, linear
tcatgaaaacatttattttaaaatttgatatttgttcaataatattcgaaattaacttntgtgtatagattttctttatatcctgagagacatgtactataatgtttgtgaata

SEQ ID NO: 1382 - DNA, 165 bp; double-stranded, linear
cggtattgatcatataaatagtgtttagatgctatagtcggntgacttaagtaatttaaagaaagtatctttaacatcggatgtgtgtataatcatttttaggaagtattgatgaatgctgttttcttctgccttgcttaaagatatatgacagggtgctggcat

SEQ ID NO: 1383 - DNA, 111 bp; double-stranded, linear
tttggtgtgatggagtatatttaggtgtggaaatcaagagggaattccattttcaaacatccaattagagtcgnaataagaactcgctatcggtccaattaactgattcag

SEQ ID NO: 1384 - DNA, 144 bp; double-stranded, linear
catttaaataacgttgtgaccatgtgctttatgctatgtgctagaaaatccatgtttttatctaatttcttaataaattgacattaagttggattcttgtccncttcacgtttcgacattggatgactgaacgcatgaaatcag

SEQ ID NO: 1385 - DNA, 103 bp; double-stranded, linear
tcgttgtgcagcaactgcattacgctgtctcattaatgtaagcgcaatggccatttggtttttcnatagtggaatacttgtcaaaattgaacattgtatcttc

SEQ ID NO: 1386 - DNA, 533 bp; double-stranded, linear
ccagnacaaatacaacgttatattcaacaattagaagacttagnatagatataaattgagggaggacatcgatatggcatttgaagggttatcagaaaccttgcaagcgacgatgcaaaaaatgcgtggtaagggtaaacttactgaagctgatataaagataatgatgcgtgaagtaagattagcgttacttgaggctgnacgtaaactttaaagtggtaaaagaatttattaaaacagtatcagaacgcgcattaggttccgatgtaatgcaatcattaacaccagggcaacaagttattaaaatagttcaagatgaattaacgcagttgatgggtggagaaaatacgtcgattaanatgtcaaataaaccacctactgttgttatgatggttggtttacaaggtgctggtaaaacaacaactgcaggtaaattagcattattgatgcgtaaaaaatacaacaanaaacctatgtnagttgcagcagatatttatcgtccagcagcgataaatcaattacaaacagtaggg

SEQ ID NO: 1387 - DNA, 112 bp; double-stranded, linear
ttatttacaagccattaatatattttaggtttgttctgcatcgattcattggtgctattttatttacattcaataatgagacttttacancaaaccaattggtcaaatatag

SEQ ID NO: 1388 - DNA, 118 bp; double-stranded, linear
acacctacagttaatagtatcagtgcacactaaagtcctaatactttcaaccatgactaatgatgtatcntcttgcccaacgaacgcgttgtgccaaattgaattagactggacggac

SEQ ID NO: 1389 - DNA, 147 bp; double-stranded, linear
cgacgacacaactttataataaaatcttagacaataacgaagggtattaacagaacttggtgctgttaatgcaagtactggaaaatatactggtcgtcgctaaagcaaatttttgctctgacctncaatggtacttgttggggaata

SEQ ID NO: 1390 - DNA, 161 bp; double-stranded, linear
tttttgatcatgatttttgggcatggatcaatcacttgcttggccaatggtctttcaacaatttggatatctgaccttattcgctttatctagcacttttgncaatttgttggcattggaaaacatgtgtttagatttttgtatgcctctcgcaggctttt

SEQ ID NO: 1391 - DNA, 102 bp; double-stranded, linear
gccgcacgcgcgcgattctcggcctaataagaaaacaaataattccaattcatatatgnacatttttgcctccttatttcttgaaaatgtggaattggaatt

SEQ ID NO: 1392 - DNA, 412 bp; double-stranded, linear
ttgatcaaaaaggtcataagacattttawggggagccatttagagaagatactttatcacaaaatgctattaacaacgtattaaataatcaagattaccatggtattaaagataaaccattcgcattattcgtaactggatttttcgacaatgtaacagataatactgttggtattaactttaagacaaaagacggttcaatagcagtatttatgcgtccagatattggagaaacatttagcgagtttagaacattcttagccgtcttgttaatgttgttattatttatctcgatttcattagttatcgcatcancctattcaatcattcgtccagtaaaaaagttaaagctagcgaccgaacgcttaattgatggtgattttgaaacacctatcaaacaaacncgcaaaga

SEQ ID NO: 1393 - DNA, 186 bp; double-stranded, linear
agcaantggattgcaatgagtttcttatatttacaaggtggtagattgattgatgttttaactgcgatattagcagtagtctagatacctagtcactgagattttagatcgagttacacgcacattatccgatctgtctatatggatatccgtatgactacctatcccacggactgcacatactgg

SEQ ID NO: 1394 - DNA, 118 bp; double-stranded, linear
tctttaaaagaatcaggagcttggaagaagtatatcaggatcattaagtcaacaaattacgcgatatgaaaatttgaataacaatttgnaaaagcatgcttccgataatcagcaagcc

SEQ ID NO: 1395 - DNA, 175 bp; double-stranded, linear
ggttacctcggatggatgattactattttgggctgggcgccggctttngttattagtggtggcaatagtggcaaagtgtcacaaaaaaatccaatagctggaaacccgggtatatttgggtattaacgccggtggccgggatttggccaatcgcattaatttaatggccattggg

SEQ ID NO: 1396 - DNA, 132 bp; double-stranded, linear
agaaacttagacgattagtatcatatattagaacacngcaccgaacttgaaatcatggctgatatcgcaccttgaagaagcaaaaatgccgcacgacttggctttgatatattggcacgacttacatggcat

SEQ ID NO: 1397 - DNA, 121 bp; double-stranded, linear
agaggtccggctatctatcaaataaagtggtcatttaaagcgtacacttcgggtgcgttgatttcttactttaggtgtaggacaattgtatcgcatctatctttacnctacctgcattgtt

SEQ ID NO: 1398 - DNA, 202 bp; double-stranded, linear
cgttcgtataatctcacttgcatcntgaattgaacaacatcctgtcattttaagactgctaaangtacagctgaaaaccaagtaagtccgtttcgtctggctgtgaaatggatcaaggaggatgcggtatacctacataaagcagatatctgtaagaatctggcaagattcgaatgcccaaaacacctcatccaaagttcag

SEQ ID NO: 1399 - DNA, 165 bp; double-stranded, linear
cgttggatcactgatgcattcataaatgggtgaacntaatgtaatgttaaatctatcacagcgcgataacagcaagaatatagtgaacaccataaattgagcatatcaatgccatattcatggatacacatagttcacctggtggtcggtgaaagcctgtagatg

SEQ ID NO: 1400 - DNA, 107 bp; double-stranded, linear
acacctttgtttttgcaaagctgtaccacaaagtactgggtagaattctacgttatatgagncttggcgtatagcttcttttaattcataaactgtaaatttcttcg

SEQ ID NO: 1401 - DNA, 106 bp; double-stranded, linear
ttttgtctagnaacatctgcttctaataatgatcgatcagcagccattgtgcttaatctttcatcccacatcacaatctcaatagaaggataagcttctaataatt

SEQ ID NO: 1402 - DNA, 102 bp; double-stranded, linear
caatgttaaacctacaccgttaacagcacacatgatactaaattgttggggtgtcatattatacaatgttgagtantaaatggcgatgcagatgaataacta

SEQ ID NO: 1403 - DNA, 169 bp; double-stranded, linear
tttattatttgtgctacaactacttaaaaaaatcagtagatatagcattaaacatattttcatccccytgaattttaaaaactttttcaaaagcaacacctctaaaaataaatacaatatattatagcaaatagaaattattattttgttaaattatgttgtncatgtt

SEQ ID NO: 1404 - DNA, 106 bp; double-stranded, linear
ttagttgataagtaaatccgagtgacattgggattcaccccaaccgactctattccagtctgaaatacgtgaacccataanatcctatgtccagatttatatttct

SEQ ID NO: 1405 - DNA, 309 bp; double-stranded, linear
tatttttgcagcagagatgttcgcgacaaggtttacgccaaattgtcactgctactgcgatgtgtattgcatgcaagtgcaggnaatatattgaacatttaaacgatcagtttaattcgagtcgaattagattgagcttaaatatttgtattattatggtcacacncgttaatatgtctactttaataagcaatttgtactgactgtcgacattgcgtcatggtctgtttttgtttaactatactatnggtgcgaagtaggcctatgtttagaggtctaacatgccgtaggtctaatggatcaggaacc

SEQ ID NO: 1406 - DNA, 144 bp; double-stranded, linear
gtggacctgcagttaattcaacgatttcaagatgggcgccaagaacgaaacgtggccgatacttaggattctggaatcatcacataatcgtgtgcatgaggtgtttcactttggggtctaatgattcttcatggaangtatagg

SEQ ID NO: 1407 - DNA, 115 bp; double-stranded, linear
acctttgcgtccagaattagctacatggtaaagcttcgtgttactattttagggatatcttcaacncgtttcacttgtataatttgtttttgtaattggtgaagtcatagtatag

SEQ ID NO: 1408 - DNA, 115 bp; double-stranded, linear
attggtattggcgctgtagtatagcttcattatctgatgccattagtatacgcacactntttatttatgggcgtggtattcatccttatcgggatcaattattgggttacatttt

SEQ ID NO: 1409 - DNA, 123 bp; double-stranded, linear
aaccagatgaaaagcaaatatacatatataactctacatggggtcgtggtttggatattgttcatgatgcattcggtatgccaatgacaaagcaatataaagataaattncaagaagataaaa

SEQ ID NO: 1410 - DNA, 120 bp; double-stranded, linear
ctntttatattgaggattttgtatcatatatggataatcattaaaggtgtatgctcttgttatcagatcgctacgggtaaaatcgcttctatagggcatttacatgcgggcttctgccgg

SEQ ID NO: 1411 - DNA, 455 bp; double-stranded, linear
tctcgtattgcgtttagagaacatgcgcacaaaggacaaattccaggtgttaaaaaatcaagttggtaaaatcaaatttcgtactttagcccatttacaatatcaataaaacaatgtacagtatatacgaatgctataaactgaatgttttctcatattaataaggaaacattcggtttttaatttgcatttaaaaataattagtttttaaaggggctatttaaagtgaaaatatttgattacgaagatattcaattaatacctaataaatgcatagttgaaagtaggtctgaatgtgatacaactatccaatttggtccgaaaaaattcaagctacctgtagttcctgcgnatatgcaaacagttatgaatgagaaattagcgaaatggtttgctgaaaatgattacttttataatcatgcatcgttttgatgaagaagcaagaatacctntta

SEQ ID NO: 1412 - DNA, 118 bp; double-stranded, linear
acaatgtcaaatcacaatagctgttgtaggcatttgattacaatgaactaaaggcaaaattggagcagttatccatgaatgattaataacaacanaaagtatggggtcaagtttaggg

SEQ ID NO: 1413 - DNA, 245 bp; double-stranded, linear
tgttgacgatataggaattagcaagaaataggctaagatagtttcgcacaacttggggcccanccacttgcttgtttgtagaattaggggtccatttctcgtgttggggcccgaactaatagtatgaatatatatatctaatattaaaacggcaatatttatatggtatacatttttatatttagtntttgtatagacatgctaattagcactttctaaaaagggttgaaatgatatactgatga

SEQ ID NO: 1414 - DNA, 252 bp; double-stranded, linear
tttttgttattcaaaatttagagtgtgttatatgataacggttttttcatagcgacttgatcatttttcgaaatgatgaaagatatgcaagttcaatcaatcggaacaaaaatactatattatggtaagaanttcccgaagactagcgcactcacacacaagtgcatcctcgcgaacaatgcgcacttttcacaagcacacaaacacaaggcacaagtgcacgcantattagacaatggtctacctaccaga

SEQ ID NO: 1415 - DNA, 112 bp; double-stranded, linear
atctgctggaagagaaaaaagacgctcttaaaactggctttagaaggtcaagatatagaagntattaaatctaaaaaagaaggaacttgaaaaagtgattccaggaattttc

SEQ ID NO: 1416 - DNA, 124 bp; double-stranded, linear
ctcaattacattcaagaaaatgggtggaattacacaacgttggactgagaagtatagttaatagcgcaaatgcnataagccttatataaaaatgggcacaattatttcatgtaccaacaagaac

SEQ ID NO: 1417 - DNA, 121 bp; double-stranded, linear
ttcaagagcacatactgtaactcgtacgagaattttttcaaaatgacgcgtcaatctcaatatcatcatatggtattccgagtaatacccctcgncaccttttttaggtagcgtcaatatt

SEQ ID NO: 1418 - DNA, 123 bp; double-stranded, linear
ctacgccatcaagagggtgttagtgctattaactattgcggcgagagcaattagtcgaatgcaaattaggacaagttgatgagtaactacngccaatatcggtaagtttcatggcggttcagc

SEQ ID NO: 1419 - DNA, 109 bp; double-stranded, linear
cttataatccttacngcaatttcaccttgtacggaattaaacaacggaggcatttacttaccccctttacttaatacgtaccaaaacttggtcgtattcaaccattggg

SEQ ID NO: 1420 - DNA, 121 bp; double-stranded, linear
gctgtngtgctgccaagatgctgattgaaaagtatatatgattgcatcagtagaagagcgagcagaaagaagatataaagataatcagttaagaggtgtcgaatcaaattttgaagattta

SEQ ID NO: 1421 - DNA, 128 bp; double-stranded, linear
tgtttttacagtcacatacactaggcatcctagcattatctaaatttaataccatcgcaacttgcgctttaatcttcaaggccaattaaacctccttcatctttctaactgcttanatataaatccct

SEQ ID NO: 1422 - DNA, 110 bp; double-stranded, linear
gccaatcattgtcaatgttcaggcatcanatttatcgaatgattttcatttgccatgatcagtcaaggcggggatttattcaaaaattatgacgcctagtaaaaaatttt

SEQ ID NO: 1423 - DNA, 111 bp; double-stranded, linear
attaccttgcatgaatttccatctgtcaaatgtgcgccttcacgaatttgttcgataaagatacgttggtcaccgtgaataatttcaccagctgcatttntccatggacca

SEQ ID NO: 1424 - DNA, 200 bp; double-stranded, linear
tgttgtgtgattgcgtattctcaggtgaattcttacatatatagtactttttgtttccgcttgatttgaccttgcatatctttcacattcttcgaaaattgatcaaagcnctattgaaaaaccgtatcatatacanacctctaatttttttgactaacaaaaagaattctttgacgtatcaactatatcatcatgacttc

SEQ ID NO: 1425 - DNA, 119 bp; double-stranded, linear
tttctataattttagactatttctaccatgttgctgaacaatttacttagataaaaattatnaaattttggtcaattaacaaagttagtttgttaaaacgtatactttaattattccgg

SEQ ID NO: 1426 - DNA, 116 bp; double-stranded, linear
aaaatggcgttgcattttactctaataacgctcaaggcgacggcaaagataaactaaaggcacctattatcgaacatagtactcctancggacctggaatttaaatcagagcggcc

SEQ ID NO: 1427 - DNA, 212 bp; double-stranded, linear
ttttatttacgtataagtgggcgttaggtgtcacagcggttgtcgatcaaaatatcatcatcaatcttgtatatgggtttgcggattcttattttatgattttacagaactatcctaggcttattctttattaaaagatgcaacnagttatataaaaagacgaatctatcaacgcgagctgctcacaaggcatctcntatagcgtccacatc

SEQ ID NO: 1428 - DNA, 265 bp; double-stranded, linear
gaaaaattggttctgaatataatggtgccgtatactttacgcctcaaatcaaagattttattcaaaagcacattgaacaataaacaaatttaaatatacaccatgagcatgtgttcaataattttaatgaaaaacatcggtcgaatataacataaaaaaacgtctatatcaaaagcatcatgaataaacagaggagcacaaaaatgantaaaaatataatcatcaaaagtattgcggcattgacgnttttaacatcaataactgg

SEQ ID NO: 1429 - DNA, 145 bp; double-stranded, linear
cgtacgaaggatttgcaaacttcttcattcaacaagctaaagaagaacgtttccatggacaaaagatttataactatattaacgacagaggtgcacatgcagaattcagagcagtttcagcaccaaaaattgacttttcaagcat

SEQ ID NO: 1430 - DNA, 115 bp; double-stranded, linear
acaccgctaagcgtattaagacaggatctgaaaatggacacatcgcaatcgaattattgcaatgccaagtcatatcgggggtgaaccgcaatttcaggnattaagtggataggta

SEQ ID NO: 1431 - DNA, 211 bp; double-stranded, linear
natgtattngtgaaaaggtcctgagtggacaaaagacctaaatatttaatggtcgattatcgcacgtccatagttggtgaacaggaacttacacgtacatctaatcgcagactatgcgtaaactttggaaactgctagtcattgaagcgtggtatgtgtatgcacgtaaatatgcattagatgtgagggacgacgtcgacgaagacaggcg

SEQ ID NO: 1432 - DNA, 145 bp; double-stranded, linear
ggaatgattgataaattggactacttaaagatttcggtatcgtgtcatttggctcagtccatgtttaatcacctatgntgacatggtatgatattagtgactaccagagatatggatgatttggaacgtggaggacttgatcgtt

SEQ ID NO: 1433 - DNA, 169 bp; double-stranded, linear
tttattgcatttacataataatatccttttgttgttttggtatttctattcatatacaagaccatacctttaactttcagagcttcccccttattttgagttgccatttcagaaccaataatccatgtacctttatcatttttatcaaattcgtcatcacgataacctn

SEQ ID NO: 1434 - DNA, 102 bp; double-stranded, linear
gatctatagttctgtaatctgacgtgctttgccatgtgcaccactcgtcntaaaaatcacttacacttaacccttttccacctttatcgtatccaccttcaa

SEQ ID NO: 1435 - DNA, 116 bp; double-stranded, linear
ttcttattatacaaatagaagccatgtgtgcttatatcgcagcatcatgactcctttttcatttgaatatataaataatacagncgctttcgaataaatttaggctaattctacca

SEQ ID NO: 1436 - DNA, 144 bp; double-stranded, linear
gggggtttatgtactggtggatctgcaaactacttggcgtaaagaatatacagatatggtaangaaaagtttagattcacacgccatcacaatggattagaaaaaccgaatttcttcagcaattctacaatttctagtatacgc

SEQ ID NO: 1437 - DNA, 101 bp; double-stranded, linear
gttgctgggnaacctatggtcgaacatgtattggtaaagtgtgaaaggctctggtggcgatcaagttggtaaccatcgtagtacatggtgctgtaaatgta

SEQ ID NO: 1438 - DNA, 321 bp; double-stranded, linear
aaagatggtgacatttcatataatccgaatgtgccaagttattcagcaaagtatcaattaagtaatgatgactacaatgtgaagcaacttagaaagaggtatgatataccaactangaaagcacctaaattattaataaaaggcgatggtgatttaaaaggatcanctataggacacaaaaatttagagtttacatttatagaaaataaagaagaaaacatctattttacggatagtattaatttcaaacctactgaatagggttaatagaagtttgaaatgaaaatttcntaaagtgtgcaaaataatttgtcgctttag

SEQ ID NO: 1439 - DNA, 135 bp; double-stranded, linear
cagttgtaatgggacctgggccaatcggattacttgtagcacaagtgttaaaaagtaaaggcgcaactgttgtgggtactgggttgggacaattgaccaagtcagattagattaaagccagaangccattgccac

SEQ ID NO: 1440 - DNA, 110 bp; double-stranded, linear
aaattattttgaacactttatgaaatttttatttcaaacttctattaaccctattcagtaggtttgaaattaatactatcagaaaaatacacatttncttctttatttct

SEQ ID NO: 1441 - DNA, 436 bp; double-stranded, linear
tctcttttggattcattaagattgcngcatcgataccaacgttmaacggtgattgtgtaatgaatttttgccaccaagcttttttaacattattctttaattcaacacctaaaggaccataatcccatgtgtttgataaaccaccgtaaatatcactaccagggaacacaaaacctctgtgttttgctaatgaaacaattgtatccatatcttttgccataattacctctcctcatacatgaaaacgccccatggaaaataacagcatagtaaatatgctttacttccatgggacgagttaatattttaaattgtatataatacaaaanaagtnacgtatttaacccgcggttccacccaaattagtgtagtcactcgcttttattttaaaatgattcgttgcgccaatcttattgttaagcttacactatcctta

SEQ ID NO: 1442 - DNA, 461 bp; double-stranded, linear
atttttagaagcatactgcgaacgtcatcacatcgatttacatatcaaaaagttagatttgtcgcatagtctcgaccgaaataacagcattcagaatgaagctcgaattaaacgttacgaatggtttgatgaaatgatgaatgtattagaagcggatgtattgctaacggcgcatcatttggacgatcaattagaaactattatgtatcgtatttttantgggaaatcaacacgtaataaactaggatttgatgagttatcgaagcgaaaaggttatcagatttatcgaccacttttagctgtctctaaaaaagaaataraacaattccaagagagatatcatattccatattttgaagatgaatcnaataaagataacaaatatgttagaaatgatattcgtaanagaattattccagctattgatgaaaataatcaacttaaagtatcgcatttattaa

SEQ ID NO: 1443 - DNA, 143 bp; double-stranded, linear
aaaggtgataaaaaacaaaggcattgtaaattacttgaaaaccaagtgagttattacacgattctaattgggataatgcgcgatattttattccacacttgttacattattgctttacgtgggggttagcgtggantcatcac

SEQ ID NO: 1444 - DNA, 90 bp; double-stranded, linear
tggtgttggttcatcagttgtaaacgcgattgtcacaagacttagaagtatatgtacacagaaatgagactatatatcatcaagcatata

SEQ ID NO: 1445 - DNA, 218 bp; double-stranded, linear
attgaacagtgacaacaaatgacaacaatgaatgaccaactgagttgcagaattgaccgacctgacttgctgtnagatgtgcattgcctgtgaccagttaactgctgtttgtacattatgattgtgcacgtgaagtctttgcaaatgacttttaacattatgctgctagagccatcttttaaagatgtttggactaacgtncatgatgtgaatatctg

SEQ ID NO: 1446 - DNA, 105 bp; double-stranded, linear
tttgacttgacattatagaacacaaattcatttgaaactatgttttcaaatttatttattgttactgggaatttcacattattagatttatttattttcttttga

SEQ ID NO: 1447 - DNA, 104 bp; double-stranded, linear
atcaacagaatatnataaccggacaaagaaggagaacaagaagttgctattgaaagaagcagactgaaaactgcatatgcagaggcgatgaaacaaaatgccat

SEQ ID NO: 1448 - DNA, 104 bp; double-stranded, linear
ttgaattaactgaagaantagcagtgcaagcaggattgttgatatgacaacattcgagtcagaatggcaacaacaacgtgattcgtgcactccaagcacgtgca

SEQ ID NO: 1449 - DNA, 349 bp; double-stranded, linear
tattaattttttttaatatggaatattcattgcatcgctttcctattcttcaagcccactttttatcttcatatacattaattaaccaccktcaaacattgtcgttagattcgccaaattgaatctatttttagcacagcaaaaaaccgaactgctgaaataatgcatctccaacagtccggtctattaaactatttacttatctttattaaacaattgacatgatttattagaataacccaattggcatgaccatgcatcagtaacatccatgtttaatggctgctggttttttaggtaaaccaggccagagtcatggntggcacctgngcaacgcnacgataaagcc

SEQ ID NO: 1450 - DNA, 400 bp; double-stranded, linear
gattttatataaatatagcttttcaacaaaacaaatgattgaatttctaggaattgagtcattaaaaaaacacttgaaaaattcaggtgggattgcgctattgccggaatttattgttgcagatgaattagaaaataaaagtttgtttcaaatagacgtagatgtcgatattccgaatttagaaacaacattgataattaatcctgaatcgaataagcamgtacttgaatcttttgtaaaagatgtttttttataattattggtgaaaacgtgtagttatggtgaaactcaaagataataatttaaatgagatgttaatgaaaaagtaattcaatatanaacaggtgatttanatcttaataaggntaattccaggttgaattccaattgcgggcatcat

SEQ ID NO: 1451 - DNA, 124 bp; double-stranded, linear
tgcgttatagttgctattctcaattatgttcgcgataattttaagtaaaagtaagcacagatattgaatttgataggagttaattgatatatacatacgaactttcatggatcacttaaattng

SEQ ID NO: 1452 - DNA, 126 bp; double-stranded, linear
tgtattaaaaaccttccacctttaaaagcaacaatgcggtgtcctttaaattcaaacataaccatatacgaattactcgataattctgtgtgtttaattgacagatgtcgtgtgaattgatnattt

SEQ ID NO: 1453 - DNA, 280 bp; double-stranded, linear
actttggcaacatctggaatatcatataaatcaagtaacttacctaaccgatgattaatattaatggattcatattctgatacgccctttaatctttcttctatttgtctttccaatttgctaacagttgtttccatgcctacacctcacgatattatcactattcatattaacattatatgtaagaaattaaaatcttttgaagcattaagattacttatcatttntaaatttcaatttaaactaacagtaatttatgtagcttttgnaattctcataa

SEQ ID NO: 1454 - DNA, 242 bp; double-stranded, linear
atattctttaaattaaactgatcacttgaataattaacattacttaattctatggcattcatgatgattcctcctcataaatgaacgttaaaatatcctgcagttcctcaagtgacatttcgatggcttgcgcttcattaaccaattctttaaccaaattttcaatggtaaaaaattgtttctcttttaaaataggaactattcttngctccttaacaaaggncccttttcctctaattgtt

SEQ ID NO: 1455 - DNA, 110 bp; double-stranded, linear
ataaaattgcagacttagattactcttgttcagcatttttaatgtatatcggtatagatattgatgtgacagatcaagtgagacttgcatantggtattttattcagatg

SEQ ID NO: 1456 - DNA, 551 bp; double-stranded, linear
accagtggttgcctttttaagtcccgcgtgggacaaaaattaacctctttacacttgcaatagtactattctatttcaaaaattgcaagcataaaacttaaattttctaaataatttgataaagcgcttgcaatatattttcgatttgttattcaacmaaacgttttattttattcgctgtagtcaaatgtatacccttatactgactcgataatcatttgcttatnatttgagactaggacataaatcaatgctctagaatccaaaaagtcacattagtagtagttaaccgaacgaaaatgcacttgtaacaagcttttttcaattaaagtcaggggccccaacatagagaatttcgaaatgaaattctacaggcaatgcgagttggggtgggacgacgaaataaattttgcaaaaatatcatttctgtcccacctcactcaaaataaatttcactatccgtaaaataaacaactaactatttaagtatcatctctcccctaattaacaattataaaaataagaaccaatattcgagacaacctaattaa

SEQ ID NO: 1457 - DNA, 109 bp; double-stranded, linear
atcnggggctgcataagcgatatcaagtgtgagcattgaacgattcaggactgaccagcacgccgtttgcctgctttgaaagatccaccgacaaatccgccaacatcgt

SEQ ID NO: 1458 - DNA, 112 bp; double-stranded, linear
accagagcctctttgacttcctaagtcgaatagcatcgttgatatagttaaagatgacgctagatttagnaatccaaactcataacacctccaccattccatcacatctgga

SEQ ID NO: 1459 - DNA, 224 bp; double-stranded, linear
ccccaaccaattttttaaaaaagggggcctttgggggggccaaccaagggggaaccccttaaccccaattttggccaattttaaagggaaggccttggaacctttttgggaatgggccggttttaaacccttggtttccggaaggggaaaatttttaaaaaaaccggaattggttggccccctttaaattaaaaagttccctnaaaaanaaattcccccaaggg

SEQ ID NO: 1460 - DNA, 135 bp; double-stranded, linear
tttcgacaatcaattcgacgtcagtgccactccatctatagtaaagcgttgatactttcaataataactggatcactgtctaattataaatggattcttacatcccaccataataaattncatatgttcatcacc

SEQ ID NO: 1461 - DNA, 114 bp; double-stranded, linear
ttatagaacctcgtactcctntcgacacttgaatttaaatcagagccgccagtggagaagcatgaattgactggtaccactcgcagaaagtaatgattctaagccacttgatta

SEQ ID NO: 1462 - DNA, 105 bp; double-stranded, linear
gttgaattgttggtgatgtggttacacgaatttcgaataattgttctttacgtcaaaacgtatcgttccaaagtaatccccnggtaatagttaccaacaagttca

SEQ ID NO: 1463 - DNA, 162 bp; double-stranded, linear
ttgtatgactcttcggactttggtaaaattgtgaacgctggntgaatgatttttgtttgacaattggccttatcatcattaatcgtatttttaagctgctcggatataagttctcagcgagttctttttgatgtatcattagtgtagaaaatagctgtttgt

SEQ ID NO: 1464 - DNA, 103 bp; double-stranded, linear
taaattggaaagtcacattcaanatgcgaaaatgttttaaaatgtcctgtaggtgcttaatagttttgcatttgcaaattttactgaaccggtttaaacgaat

SEQ ID NO: 1465 - DNA, 153 bp; double-stranded, linear
aaattgtataactaccaagcttatatgaaatggtaaacaaaatattatcacttgtttgataagtagcgtggaaaatattgtatctttctaaatgtacacgttagaantcatgcttatgtattacacgcggggcactggtacctaagggcctat

SEQ ID NO: 1466 - DNA, 124 bp; double-stranded, linear
tttcagtaacatatgaaaacttaattaacgatgttcagtaggttcatacattttactttatgatgcttaattgaattacanttaagatatgaccagctaaaaagagttaatgtgatatttaacc

SEQ ID NO: 1467 - DNA, 354 bp; double-stranded, linear
aaggaattaagtttgcgacaccagcaaatagtactaataaaggaatatatggtaagtcaataattgaataaccgatatataagaatatacctaaaataacactgacagttacttgaccttgaatgtaagattttaatgtaaagtttaaatcagttaataaatctacgaaaaatactttacgttcacctttganaaatttagcaacagctgggataaatttttcatggtcttttaacatataaattaagaagaatggaaccataatcaataagaagatggttgaaattaatgatgtaatgtactgtaatgaattagataanatattagnaacgccatcacccattgatttaacca

SEQ ID NO: 1468 - DNA, 120 bp; double-stranded, linear
tgcaaactaggaacaataatgttaatataactatgatgnaagttaaaaaataaaaaggaacactctataatatgaattagggtttacagttttttgagtattttacagtatcaaagttta

SEQ ID NO: 1469 - DNA, 476 bp; double-stranded, linear
tctaaatgctgactaaaactagcaacacgagactcattattattagacacgattgtaatagtgattcctttttcattagcttccttaaaccatgctttaacacgttctgtaggttctttaacatcccaacctactagcgtattatctaaatctgtaataatacctttaacgcctttgtccactaacttgtctaaatcaatttgaaatattgattgaacatatgaattcggcataaaaaacttgcgaactaaacccatttaactcacctttacctttttataattgagacactaatgcttcaacagtttgacttgatgatacagctgctttttctaaaaatgcttcgaagctcatttccgcttctccatttgctaagtctgaaactgcacgaactacaacaaatggtacattaaattgataacatgtttgtgcaattgcagttgcttccatttcaaccgccatcgcatttggaaatg

SEQ ID NO: 1470 - DNA, 156 bp; double-stranded, linear
caccatacatgggtaaggatactactcaaatcaacttgaaaccaataatncatgaccatatgtgtgccaatgaattcaattggaaagacaatgatgagatactattaaaacgattatatttattgtcacttgttcaaacgcactccttttccaaat

SEQ ID NO: 1471 - DNA, 400 bp; double-stranded, linear
aacaaaagttttgaaaagccgggtgccagcgaaaacttaaaaagcactttatcagaaaaagctaagaaaaaagattaatattcattcattaaatataaatccaatttaatttgttgtttaaggtctacaagtgtatgtttaatatacaattcatcgtttgacggtaaatcagatactttgaaatcttgtcgctcaacctctagtaaatcgaaatcgctaccagctgaattataggttttaagttcaccctcttcaatgattctgttttcaaagtctttaataactataaatactggtttaccgttgttattaaacaacttgtctcttttgtctaataagcttatacaatccaaattcataaactttcttgtntcatnaattaaccagataatgaatttaa

SEQ ID NO: 1472 - DNA, 106 bp; double-stranded, linear
ctaggattncatctatttgggatgaaaataagcgtttcctgaatccacaagaatatccagtcgatttaagccaggcatgttggggtaataacataacgttttttga

SEQ ID NO: 1473 - DNA, 117 bp; double-stranded, linear
tatcttacctacattgttatctgatggctgtaatcattaaatctataacaccgagttcttccattaattttcagcttcattcgactgcctttttatntttcgtactattacgaattt

SEQ ID NO: 1474 - DNA, 164 bp; double-stranded, linear
atgcatggcactggaancagctgggagatataggtagtatcctaaagaagttcagttaatcggagcgattgtattgcatgaaggtaacattgcggagtgccaacaggcgaagtaaaacttaacggcaaccatgccttatattaaatgcccttccgggaaaggac

SEQ ID NO: 1475 - DNA, 210 bp; double-stranded, linear
acagcaagacgtgacaaatcagatactattagtcatcagcgttaacatgtggatangtgtgaggtacgaatanccgaaaggaaatacgacctttaacattcgcgcacaaaatgagctcaggcgcctgccttgcccattttttaaattatttccctggaaatgattcgctgtgtgctgttctgtccacaacaacacgattaatgccatgac

SEQ ID NO: 1476 - DNA, 128 bp; double-stranded, linear
agggtgatttcacggttcgtctgcccatttaattgcgcattttgcacaccatctaccgtttgcaattttggtattaattgttgcatgcagtactgtccgttgactttgntgcaagtgcatgctctttc

SEQ ID NO: 1477 - DNA, 641 bp; double-stranded, linear
aaaatctggtaaagtaactagagtttaataaatatattgcacataaaaaatgtgaccttatgtggaggacacatttacttaagaactaagagctcaacctcttagttctttttttgttaccaaacaatacataatggttcatagtgaaattcgaactatcaatataatttggttaatacgtttaataatggttctctgtcaaattggacttatgggttcaatatcgattttggcacataaatcaatgtactaggacctacaattttcctttcaataataaatcacgccataatcttcattaattacagcgtgattcatctattattatgttataaatkctatctataaacgtcactttattaaataactcatgcactttattaaaaatcctcacaaatttgaatatacttaatttaaatctgtacttctaatttgcaaaatcaacccatcatgtacagttactttcgcttgcaaagactcaatttcatttgaaatagttaaagtagaacctatatnaagcatttgtctagctaaattatatttaaaacctgctagagaaagttctacatcatcagtcatcgggataaatgaaatgggacggataactcttatctttttcaactgtaggtgacctttagggc

SEQ ID NO: 1478 - DNA, 121 bp; double-stranded, linear
ttaaccgtgatgcagagtagtaagtggatncatgctctgttatggatgacaagacaaagcagcgaatattgcgtactgcgattgatgagcagatgcatatgattggattggtgcagctgtc

SEQ ID NO: 1479 - DNA, 133 bp; double-stranded, linear
accattgcttagataaatacctcgcagtgaaccgcattagtatagcacttctagctgatcgcatcagtaaagtatgctattaatgtctcagttttatctgtaatgcatgtttaagttagtcatagcattattn

SEQ ID NO: 1480 - DNA, 201 bp; double-stranded, linear
ttttggggnttttaaattttaaattcccgntgggggaaattcccttaaaaattcccaacccttttaaggggtgggggtttttttagggaaaaaggggcccggggttaatggttcccaaaaaattggggaaaatggccccccaaattttaaattcccggttttaaaattggggtgggttaaattggaaaaacccccaaattt

SEQ ID NO: 1481 - DNA, 112 bp; double-stranded, linear
cagtatcaagcatagtaaaaaatgagggtaggactgaaaatacggcgttattggtggtgcattcacggtaaatatgttgcatgaccagcaagttttggncttctgatgcacc

SEQ ID NO: 1482 - DNA, 127 bp; double-stranded, linear
caaaaaacaagttctgatatgcagtagctgaataattttgctagttacaccanagtgatcttctggtgttttactttttataaatgttttcatatatttcatatgtataaaaatgggatttagcgta

SEQ ID NO: 1483 - DNA, 83 bp; double-stranded, linear
agtggtgtattgggtgagtaatgcttaacttcatacctggtgcattggctgttcagtatcattatatctgcatgggcgatact

SEQ ID NO: 1484 - DNA, 201 bp; double-stranded, linear
tattattgatgttctttggttcattctttggtaataattttgcacttgaaaatttacaaccgttagctggaacctagncaaagggatgggtttagtggtctattgtgggtttattggtattccgtgggccaccccatggggccattatggtttgggaattttgggaataaattaatttncccaaccaaaaaccaggccaag

SEQ ID NO: 1485 - DNA, 210 bp; double-stranded, linear
ctcacagcaacatcaaagaggcagatattagtcaagttcaacgtaataacatctaccttcacaagtcgataaaggagcaccatcattaataagtagatcaacaagtcaacgagaattttaatgtgcagaatagagaagtacaccacacanataatcaagcgatgtaattactactacattttncatgacagagtgaacctcaacagcggt

SEQ ID NO: 1486 - DNA, 158 bp; double-stranded, linear
caggttatgtttgcattagaagttcttggaaaatctttatggaacgtggtttacaccctgactttgaattgcatcgatctgatgaagataaatgaaattgaatgggatggccnacatggaatgcaacctatgacttggatggaattagatgaagcggg

SEQ ID NO: 1487 - DNA, 114 bp; double-stranded, linear
tggtaaaaagtaagcgtaagagactgattgtagtattatataganaccagattgcgacatttgcagcatatagaggtagaggcatcgcgacaaagttattaacgtcattacttg

SEQ ID NO: 1488 - DNA, 108 bp; double-stranded, linear
tgctaagtgataaaaagaatgataagccaggtgtaccaatgggtcctggattagaccatttgggagatatcgttgtaccacatgttgatcaactaacgttnccacatg

SEQ ID NO: 1489 - DNA, 112 bp; double-stranded, linear
caanacgtaatttcatgatgaaagtggtcgataatttcttgaaacatcgctttcagtaataacgcctgctttaaggtcacgttccgcataggtgtactgaggatgttgatgt

SEQ ID NO: 1490 - DNA, 265 bp; double-stranded, linear
cagaacgtttaaaacaaagttggaaaagttttctaatcgtattagctgcatgtttaatacttattattgcaagtgaaacgcttattttcctttagtcatttgaccgatgttaaagaggtgagatggttatttagaatcattgtattgattgtttttgcggtagtgatgttcacaatttatatctcttatcatcattatatgaatgactttttagttactaagttatttaatatttccgcagcgacgccatagttattatgtctat

SEQ ID NO: 1491 - DNA, 113 bp; double-stranded, linear
cnaaattggccaggggctcatccaatattaaaataggcgtacgagggattaatagaccacctaatgaaacgcgttggttgttggacctccagataaatcctgggggtcggtgg

SEQ ID NO: 1492 - DNA, 276 bp; double-stranded, linear
actaagaaaatccgaaatcttttccgcttcttttaaatacgtaatacttcctttttttcgctctaaatgtttggcattcaactcataactattcattagtttcgttaagccttctgcatgactctcattttgagaaaaaatttccaaatggtacgaagatgtttcagggttattcactgagccacctgccagaaaagctcctctcaagtaactgcgtctcatttcgtcatcttgaatcattgaaatgatcaatttcatggcgnnaaaatgccgtct

SEQ ID NO: 1493 - DNA, 110 bp; double-stranded, linear
gatgacgagcgccaattatgtcacttttatggcaaaagctggaactaaacaaccnagcctgccagtaaaattggcaattgggacgttcttagcaggtgcgtcatacatac

SEQ ID NO: 1494 - DNA, 200 bp; double-stranded, linear
aaaaaaaaggttttttacccggaattccaaanttttaatcccttaaaaaaaattccggccaacccccaaacccaaggttttttccttaaccttggaantaaccaaggttttttttccaaaaaattttccaaaaaaggaattacccaaacccttaaaggttttaaaattggggggggaaaaaggcccttttagggggggaa

SEQ ID NO: 1495 - DNA, 253 bp; double-stranded, linear
aaaaaatttggtgcatttatcatatggagtattaatctgtagaagtaaaggcgatataaatgttactttggtaataaagattacagcgaacgttattattgctcaggtcagatcaagaaattggtgtccgggtgacaagacttggtggcgcggtgtagtttgtcagttgtgtggtcatcttaaataacgctatcgtacggtgtgtatcacatgaagggactcttactaattctgcaagtacacgtcacgcnnt

SEQ ID NO: 1496 - DNA, 104 bp; double-stranded, linear
acgctagcttctgaaaaaataagtgaactatggatgcaatgancctattcctgaatgatattagacgtagcgcacctggtgcagaacgccaataaaaagacaag

SEQ ID NO: 1497 - DNA, 100 bp; double-stranded, linear
agggaggcgcccaaatggctctatattaaaaaaggactctcagagcattaatgaaaagttgaagctcaaaaggaancgaaagaaacaagtatcaaaacat

SEQ ID NO: 1498 - DNA, 101 bp; double-stranded, linear
tggaactttggggaagtcaaacggttgtaatcgttgaacataaagttaaacacattctggatcatgtcgancgcgtccatttgatggatataacgggaata

SEQ ID NO: 1499 - DNA, 127 bp; double-stranded, linear
agttctggtgcatcgtttttcattgtatttgtgacgattatcattccagcattagaatattatgcattatatttaggtgtgataggtgcatttataggtggtttaactgtttatacactttcaggtg

SEQ ID NO: 1500 - DNA, 560 bp; double-stranded, linear
tccccgctttaataccttccacgatttctttaattgcttgcggttggtcaccttgaggctcaaaatcagaatgtattttaaaaggataatgttcaaccattgtcacatatgcctcctctttcaacgtattatttatatttccgctcaactctttgctttctcatnacatatnttagcaaagtagtcacacaaaaagcaaacgttkgttcgtaaaaatgtcgaacaaagaaanacaaacatagttgtgctaactatgctggccttaaatccaaatcgtttatcttgttatttttagtatgtaaatacacattatattaatcatcattttgtttcaacaaatttgtttgaaacattattttaaagttaatcttagcgatcttcatcttgatgtttatgaaattcgagttgatctataattaaataaccagctaataatgacactacatcaataaaaataatccactcgttatggaaatactctttatagattgaggcaccaattaaaattaatgtcagaatagtaccgacccatttacttcttgttattacactaaataata

SEQ ID NO: 1501 - DNA, 102 bp; double-stranded, linear
attaaatcatactnacaattaccgatgacattattccaattcaatctaattccgtgatgaaagagccacgttttggttacttcgtgggcgtgaattattatg

SEQ ID NO: 1502 - DNA, 400 bp; double-stranded, linear
tatggtagctccaaatggttgtatcgtcacaccatcatcttcaagtgcaatgcgatgtaatcgattggctgttgtttctgttacccatagtactttttcatctgtacttaaagcaataccatttgctacgctaatattttgaatgataggcgtcactgttctaaagtccggcgaaacataataaacgcctcctagtggattggtagagtatcctctaaaatctgtaaaataaaatccacctttagaatcaaataccatgtcatcaatacaatatgctgttgaaagatcttcaataatatcttgtaagttgtcaccattttctgtagctgcaaaaatgcctccnggagatttaaaatctccnaaaataaccaacgnataaatcgggcancttatggaattg

SEQ ID NO: 1503 - DNA, 168 bp; double-stranded, linear
tacaggtagttaacagttgatgttaaatggcgtactggattctttacgcacgattttttgttaataagtatgggatagcacattactatatcctacttacgacttattggatatgtcntagctattcttaagctcgaaaagtttcacaggatacataagggaccaact

SEQ ID NO: 1504 - DNA, 237 bp; double-stranded, linear
ctactgattgtgtaatgtcgttggtaggcttgggctgtacgcagtattaggtgtaggcaacttggcttttggcatctaccttgtatgtgtcgtgtatctanggctggggcttgctccttcagttgttagacagtagggggtaatctcaggggtgcaatgtactccctccgtcctaaaatactntatatgctcgtgccgaattcctgcagcccgggggatccactagttctagagcgg

SEQ ID NO: 1505 - DNA, 209 bp; double-stranded, linear
cgcatttaccaccatatgatggatccancgacgttttaataaagataaaagtgacagtagcgggaaaacaggnccataattcacatctcttttgaaaaatatgttcaagctaggatcattaggagagtcatattaataataaaaatgttgcaatcaatcgacgtgcgttgaatcttaaatacataataaatgttgtagaagatatgggt

SEQ ID NO: 1506 - DNA, 121 bp; double-stranded, linear
aaaatgtggctattgattttgacttggaactttttgaacatttctctcaaggatttaaatgtaggtaacagggcaggtactacggtacttncctatttttttatgcaaattttaaaaaaca

SEQ ID NO: 1507 - DNA, 144 bp; double-stranded, linear
aatgacaaggtcagcattaaaaccatttaaaaataaacgcgttatggttactggacgtatacaacgtgttttgtttaaaaattatttagatagacatagcacatttaagccgaatgtaaggatattattaaaagangtatttgt

SEQ ID NO: 1508 - DNA, 139 bp; double-stranded, linear
ccgattgaatctgtgtacacttcaccaaagatatctttcttcgtttcttcagataaactttccattgctttcttatcaacacttgtttctactaataagtgtgttaatttgtgcttnttaacaaactcaatagcttgtc

SEQ ID NO: 1509 - DNA, 155 bp; double-stranded, linear
tctgcctgcctcggcctcccaaagtgctggcattacaggcatgagccaccatgcctggctgggacattattcaaattgaagtgaggacatgatgttaaaaagttctgggcaagtattttacaagttaaaatacagatgtaagacttgacttgatc

SEQ ID NO: 1510 - DNA, 87 bp; double-stranded, linear
atcccaatgctaatgaatttgcatatacgataaataatgctttttatcatcaataaagctatgaatctttcaagatcttcattgaac

SEQ ID NO: 1511 - DNA, 217 bp; double-stranded, linear
ataggcgtttaccagttattttcgaatccatataattatgtttgtccgtttggtttaatccaattaattgattaagtttttccaattcctttttttttaattaaaattccaatccttaaaaaaaattggaaaaaagccttaaaaaaaattggttaattttcccaagggaattaaaaattttggggttttttnaggncccttttgggaaaaacccaac

SEQ ID NO: 1512 - DNA, 101 bp; double-stranded, linear
tgacattgcatcggattatgttacatcanggacaacgggcctcaaaaagcggtgcacaaacgttccgtaatcatatgccagtgcaatcggatgtaaagaga

SEQ ID NO: 1513 - DNA, 114 bp; double-stranded, linear
gattttattgaaatgattttacctgtgatcaattattgtaacaaatctacaataaaattgtcttactgcatgacctaataanatagcaacagatatcatacacacttgtaattt

SEQ ID NO: 1514 - DNA, 77 bp; double-stranded, linear
acatatacaggtacgtgtttagtccgtcgtatactgcaaaattatgtccgatgaaattaggggaaaattgtagaacg

SEQ ID NO: 1515 - DNA, 102 bp; double-stranded, linear
ccttataaagttaatgcaagcaacatggacaaattattanttgaataaactgcaagaaagacaacaatcattcttcggaatgctaggagaatatattttaga

SEQ ID NO: 1516 - DNA, 89 bp; double-stranded, linear
caattttaaataggatttttaagaccttggttgggttttggtacaattaatggggacatgactaggtcttgccacgtttatatgcatct

SEQ ID NO: 1517 - DNA, 102 bp; double-stranded, linear
gtaagagtgcatagtttttaaatgttgcttgtctggtntcattttggcaccatacagttcgtacctggattagggaaatgccaaatgtccgcgtagtgatat

SEQ ID NO: 1518 - DNA, 448 bp; double-stranded, linear
gagaactccttaccacaatcaaaagtaattgatttaaatatatgagaagataaaatgaaaaggtgcaagcagtattaagaatttaggtagcaagaaaacaagaagtggtacatacgatgctaacctaaaaagaattggagattaaaatgattattaaccttgaaacacaacaaatacattttgatttagaacatgaaattccctattttcaagcacctgagaaaaataggatacgcttagatattgatgttctcaataaaaagcnaatttctaatattattaatgttatatttaataaccaatcaaagacgaaatgtacatttttgtctgaatacttatatcctgttaaatttagagaaaaaacaagaattggtcgtttttttaatattactaactggtacgaagaaatccattctaccgatgagaagtatgtnattgcaactattaa

SEQ ID NO: 1519 - DNA, 304 bp; double-stranded, linear
atggacgaaagaagatgtcattgcttttgaaaacctaacaaatattaaagtaaatttaaaaggtagcggttttgtgtcccaccaatcaattagtaagggacaaaaacttactgaaaaagataaaatagacgtaggaattttcatcagagaatgtagacagcaattcgacgaataattctgattcaaattcagatggtnaagaagaaatctgacagttaaaactgacagggataagtcgggactnaacaggaatgggctacntttaaatttagggatggtattgggccactatttggtttttgac

SEQ ID NO: 1520 - DNA, 322 bp; double-stranded, linear
atgacgtcgcatgcacgcgtacgtaagcttggatcctctagagcggccgccctttttttttttttttttttttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatganaaatacacagctttggtagggnaatggtcctggaaataatgtaatgccaagtntctgatcatttaacatatcactcacctccttcttcatctgatgt

SEQ ID NO: 1521 - DNA, 105 bp; double-stranded, linear
taaatacaaaccctttaaacatatttactaagtcgttcaattgttgatttgataantgatgtgatgtggtattttgcatcggtcctgcttgattccagacatgtc

SEQ ID NO: 1522 - DNA, 118 bp; double-stranded, linear
tgatcatgcattacattattctaattgaattcacaaccacacggaccacatctcctatgagatcgtatttcccagatgtaaattcngtggacaattggcgtcaaatagcttctagtgg

SEQ ID NO: 1523 - DNA, 157 bp; double-stranded, linear
cngcatataatcccgcgacatgtcttttacgggtgcacttgtaatattattaccccccgtataacccatgtatatctatactttaccacataaaataattccgggactatttggcacatgttttgggtgaatttctttagtggcacaccacccctgg

SEQ ID NO: 1524 - DNA, 82 bp; double-stranded, linear
actgaggtaggttatgtaggacgagatgttgaaagtatggttagacatcttgttgatccttgagtaagattagtcaaggccg

SEQ ID NO: 1525 - DNA, 400 bp; double-stranded, linear
gatacaaaaaagaagttcaatttgaactatgaagaaatttatattttaaatcatattttaagaagtgagtctaacgnaatctcatctaaagagattgctaagtgctcagagttcaaaccttactatttaactaaagctttacaaaagctaaaagatttaaaattgttatcaaagaaaagaagtttacaagacgaaagaacagttattgtttatgttacagatacacaaaaagcaaatattcaaaaactgatttcagaattagaagaatacattaaaaattaaatcaaggttaattgcgtttaataacattgaacgataacaatttattaaaacgaagttatttattcagcattgggacataaaattaacttaaaatttaaatattgaagagcttaattaa

SEQ ID NO: 1526 - DNA, 125 bp; double-stranded, linear
actgtctaatattcactcccttaaagtgtttttcatatttttctattaatgttcatattgtagggtgttgaatgcatctaagcattncaagttattctccaagttcatcaatttcaaaatggaac

SEQ ID NO: 1527 - DNA, 112 bp; double-stranded, linear
catgtttatttatgtttcggctttaatgttgaagagttttacaaagtttaccgattgcattttataattttaatgcattattggagcattggctatcatctattactgcgna

SEQ ID NO: 1528 - DNA, 115 bp; double-stranded, linear
gcgaagatgaggatgagatgactaaaggaaaatattgaaaaacaaccaaaaaactgatgaacattattaaaaatttacaaaatcaaatcgacaacttgagcgcaagaacnaacag

SEQ ID NO: 1529 - DNA, 400 bp; double-stranded, linear
atggatcttccgcttctcttaattgatcaattaaatcagacatttcatgtttttgtaaataatgattcgctttaatggattttttacatgacatcatgattgctacatcttcacgtaattttttgatatctacttttttctcttccaaaattagctcaatcatatctttaataatttcttctacttcatctttagggaaccaaactggatagctacttacaatataatcatgaccaccaaaatgttctaacatgatacctacttgttgaagctcatttttatattgatcaatgactaattgttcatcttttgaaaaatgaaatgttaacgggattaataaatcttgtacttcattggtaacctcacctatttnatctcgaaaatattcatatnttatnct

SEQ ID NO: 1530 - DNA, 97 bp; double-stranded, linear
taacagtcaacccacccattaatatatattcaacggctgactgatacgacgaacgtcaaagaatatgagaggaatagggacaagatcatcacacata

SEQ ID NO: 1531 - DNA, 150 bp; double-stranded, linear
tcataacggtgcaacttagagctgacgtatagttcattccaactatatacgatgtatcaacaccatgttccagttttaggttaacgatactgtataccgtattatgtcagnggcaccttatcttcacgtactttacggcgagatgatgac

SEQ ID NO: 1532 - DNA, 138 bp; double-stranded, linear
attcattctgctaaccagtaaggcaaccccgccagcctagccgggtcctcaacgacaggagcacgatcatgcgcacccgtggccaggacccaacgctgcccgrcctatcctgaagccaaaggaaatgagatcggaatt

SEQ ID NO: 1533 - DNA, 460 bp; double-stranded, linear
ggggnccnggcaatggaggcgtgcttggatggtgcttggaatcatccctttggcctcgatcataagcttaaacttttggtgctggngccactggagggaaatcttcaattctggcaaatggtaattncctataccaacatttaaggcatgtggtaatgctggctactcccgcttcgttatcagctacatgacaaatacagatgccatcacctttgcgtccattttaatcgttgatgcttggaaatgttttttgtaaatatcaatgttatccttcgctgtatgtatcgcatttatatctggtagcaaaaatgttccaacagaaagccctatacctagttcggcagctattttggcagatgttgcgctactacttaataaccacatttctggaaaatgatcatgtgtggtgcactacgatcgacttggttatctttattgttagataatacggaatacgnaa

SEQ ID NO: 1534 - DNA, 145 bp; double-stranded, linear
tacgctaataaatagttcacttttccattttgtgtagtcagctcattgtattcttcaatttgctcttcatttaatgccgcataagcttgatcaataatatttggattaagttgtccaatatactctaactggtcatgataaacan

SEQ ID NO: 1535 - DNA, 151 bp; double-stranded, linear
acgcgatttaatcgttcgttccaacgatgtccactcccctactaataattaaaatcattacaaattatttcaaactttacaattnaaactaacagttttctcaataaaatgcaagcttttctcatttgttatttagaatgattatgattta

SEQ ID NO: 1536 - DNA, 86 bp; double-stranded, linear
ataatagaatcattacaaattatttcagactttacaattaagactaacagttttctcaataaaatgcaagcttttctcattgttaa

SEQ ID NO: 1537 - DNA, 400 bp; double-stranded, linear
accaaactgtaaagccatatactgaacatattgatagcatactcaatgagatcaaattacatcgtgaatttattatagaagtaccttatatgaattcaaggaaatttgagctactgattgctaacattgaacaactttctgtcgaatgtcattttaagcgaacaagtcgaaagttatttatagaaaagcttaaaagtgttcaatatgatttacaaaatatattagatggcgtaacacnagagggtactgatggttaaaacagtttatgtaacaggttacaaatcattcgaattaaacatttttaaagatgacgcacctgaagtacattatttaaaacaatttataaaacataaaattgaacaactgtnggatgaaggattagaatgggngttaatacaag

SEQ ID NO: 1538 - DNA, 136 bp; double-stranded, linear
atatcgttactgctgtatgtttcaatatctatattcataaatttcaaatnctgacacctcaatttctttaaaataaggggcagaacccactatgactataggatctctcacaggtcaattcgcaaatcactcgtgc

SEQ ID NO: 1539 - DNA, 85 bp; double-stranded, linear
taaatatctcggcacaatgatgcgggatatttttttacaataggcataaaggctggaaaaaacatatctagtgctatgatactta

SEQ ID NO: 1540 - DNA, 73 bp; double-stranded, linear
acaatttgtttatttcaacaaattatctttattccacgatgtgcacaagtggttgaaatcagctgaagacacg

SEQ ID NO: 1541 - DNA, 106 bp; double-stranded, linear
aacaaaagctggagctccaccgcggtggcggccgctctagaactagtggatcccccgggctgcaggaattcgatatcaagcttatcgataccgtcgacctcgaggn

SEQ ID NO: 1542 - DNA, 87 bp; double-stranded, linear
acatcaactcacccataatatatattcacggctgactgatacgacgaacgtcaaagaatatgagaggaatagggacaagatcatcac

SEQ ID NO: 1543 - DNA, 400 bp; double-stranded, linear
gcttattctgaaaaatatttaaattgaagaaaagaatattctaactacggaagtggtattaactaataactagtatcctttataaataaacataaaaatattcaaacgaaggtctactaaataactatccataaagtgagtataagtttgtttgtaaaactgaagtaaaaagcataaggaattacactttaaatacatatagtacttacgaatagaaaataatcccttcaacagtaatttttaaacaaaaataagtgttgttttatgttgactctactagaataacttgatattatataaaagtcgtcaaacggcactaatatttannaaacaaatgttttaagttgttggatttnaaaatattgaattaaagtgtaaatttggactattggaaattgcg

SEQ ID NO: 1544 - DNA, 103 bp; double-stranded, linear
ataacgctaatcagccacattcagtattgttaaatggacacacaagcagttgatgaaaataatagcgagctagagggacccggnctaacccaggggcgggacg

SEQ ID NO: 1545 - DNA, 108 bp; double-stranded, linear
ggctgttattgttgtggagttaaaaatgaaggaaaattataaacatggtaagcgtgtttctcgtattactttacttaaacnaacggtataaccatacctaacttagta

SEQ ID NO: 1546 - DNA, 554 bp; double-stranded, linear
aantatgtttcatatattatgaatctagccttaatcatattgcattcaaaataattttaaaaaatgaaaagaaaggatttagcatgcaaaaattcaaagactttttttacgatgatttatcggttacacgaggaaattattttttaactttaatggcagcattttttattactatcattttatttatcggcatagttgtcagtgaagtacatttactttatagcatgctaattgtattagtaggtttaattctattgaggctattcaaaatcaatttattctcttttaaaaaattaacattgtctcaagttatttatattataggcggtgcactattaatttatgggttagataatctttatttatattttcatgacgtaccggcaatgaacaacaattagagcaagcaatacggaaatacaccattctatatttctattttcactgtaccatcatccccgctattgtggaagaaattgtttttcgcggtatgataataagggktatcttcagaaaacacttgtttttagggttaattgtgtctagtttagttt

SEQ ID NO: 1547 - DNA, 400 bp; double-stranded, linear
taaagcaacacttttaatcccttttgaacttagtttatccgctaaatcataagcttcttttttgctacttacaaaaatcaatccttgtaaaatttcacctgaatatccatagtaatctgtcttttgaataatataattaactctttcatcagaagttaaatatctcagtttagttacatcatcttctttaataccttgatgtacataatcagtcacaccaaaataatgaaatgggacataaaatatcactttctaatgctgcttgtaaccttatttcatatgcaatattataatcaaacagttcaaatatacttaattcatctggatctttctggtggtaggcaggtcattcccagcangaacttagggtttggaggtaggttaaaatactcggttggat

SEQ ID NO: 1548 - DNA, 73 bp; double-stranded, linear
cgctctagaactagtggatcccccgggctgcaggaattcggcacagcatatctagtattttaggacggaggga

SEQ ID NO: 1549 - DNA, 73 bp; double-stranded, linear
gtatccaagcagcttttaaacaatatggcataaacattattaacggctatggtttaactgatggcacctcttg

SEQ ID NO: 1550 - DNA, 120 bp; double-stranded, linear
ttattgtaaccatcactttggatacagaagataaaccagctaagcaggcaatacaacccagtaacatgtatagtgaagtgactactaagaagncgtattgtgatattgatagcagctgat

SEQ ID NO: 1551 - DNA, 192 bp; double-stranded, linear
ggtatgtattaattaaaatgtggtcatgattgaaacagcaatgtaaaaatagcacaacataattnataaaggagagaaacggcatgcatgaacaagattttagaattttagagggtcaagatattactttgccagaattaggtagagaattaganaatattacaggacatacgattgctgattctactggcg

SEQ ID NO: 1552 - DNA, 76 bp; double-stranded, linear
ctaagttagatgctagtatacaagatttacaacaaaaggtactggaatcgaattgtgaactagacaaactaaactc

SEQ ID NO: 1553 - DNA, 135 bp; double-stranded, linear
tgtgttggggccccgtatattgaaaatttgttataggtgtatttctttggttaactattgttatataacttgtagttttaggatgttgattttgcttaccttgtctgctatgtaatgtcacatcaacatgattna

SEQ ID NO: 1554 - DNA, 104 bp; double-stranded, linear
tttganatcaaattcacttcgcaaacgtgtccaagcgtgagcaaagggctagatgattaatagttgccccactaacgggatcgccccagttatccaacttatct

SEQ ID NO: 1555 - DNA, 100 bp; double-stranded, linear
aataagaaacangacactagctcaccacgacgcgcacggcctgcgtgtaaaaatgttggtggcgcgggttggagatcgtgttcaaccagagcagaaaata

SEQ ID NO: 1556 - DNA, 86 bp; double-stranded, linear
caatgaaattatttattattttaagtgcattaaaccccgatgatggctgtccggtaccaggtgcattttggtgcccatggtttacc

SEQ ID NO: 1557 - DNA, 78 bp; double-stranded, linear
gtcatgttcccatcaaaactaatttgtacttactaaaggctcagcagcgcaacaattaggacaatacgtatatgaaca

SEQ ID NO: 1558 - DNA, 82 bp; double-stranded, linear
aactggttacagaaataccacgttcttgtttcaactttcatccagtcacttgatcgcaaatttaccagtcttcttcccttta

SEQ ID NO: 1559 - DNA, 78 bp; double-stranded, linear
ccacagcggcactatagccagcccctaatatatacagtatttgcatctgactcattggttcataagtatatgcagtga

SEQ ID NO: 1560 - DNA, 76 bp; double-stranded, linear
accatttgctaactttttagcagcgcaatgttcttattaactgcttacgccatctataaaaataaacgttcaacaa

SEQ ID NO: 1561 - DNA, 200 bp; double-stranded, linear
ttggaacccaaatttttttaattttcccaaaaattggggggggacccccaattcccttaagggttttccttgggggccgggggttaattccacccggggttaaaattttcccaaaaattaattttngaaaagttttaatttaaggaaacccattngtccggaatttttaccccatccttatggggggtcccaaagattcc

SEQ ID NO: 1562 - DNA, 400 bp; double-stranded, linear
aacacagagaataaccaagagaagacgttttcatctgaagaaagtaacagtamgccatttatggaagaaaatcaaaacgatgagatagttataaaagaagattcatataatccattcgtaacgaaaacatctgaaagtttaatagctgatgatgaatcttctggttataataatacacgtgaaaaagatgaagactacttcaaaaaacaacaagaaattttacaagaaatggatcaaacatttgattcaaatgatggtacaactgtgcaaaattatgagaataaagcgtctgatgattattatgatgtaaacgatattaaaggaacaaaaagtaaagaccctaaacgaggaattccatatatggaattgttggncagtcatggaacgttattattgctca

SEQ ID NO: 1563 - DNA, 454 bp; double-stranded, linear
tcttcatcatcttctaatttaccagctggaatttctagcaatggtttttctactggtttacgatactgtttcactaatacgacttcttttttaggtgtcactgcacaaacarcaactgcaccattatgataaactaattctcttgttgacgtttcaccgtttggtaatgtcactgtatgaatttctacatctacaattttgccattataaataactgttcgatcaattgttttttcatttaaatccattataatcacgttcctttaaattcatattatatattgatacactatgcttgttagctaaagtgtatcgaaaggagaacagacatgcaaaaaaatatattaaaaagtggtatttcattatctgaattaggtctaggttgcatgagtttaggtacagatttaaaaaaagccgaacaaattataggattgtgctgttgaaaatgggtatc

SEQ ID NO: 1564 - DNA, 69 bp; double-stranded, linear
acatctcgcatcgtcacgacttgcttgaaccactagcaggtcaaacaaagctgtacaggcaacatctgc

SEQ ID NO: 1565 - DNA, 117 bp; double-stranded, linear
tccagaaccattttaaatcccgggaaatataattacctccactaangtaatatatccaagccaagactaatcctccttaagccggtttaagtaaccaggttgagaaggattttttgg

SEQ ID NO: 1566 - DNA, 103 bp; double-stranded, linear
tattgagattaacagtctgggaaaaatgaacagcaattgtntaatgtgacgatgctgattactttttaacagtatcatttaataactcagagatgcgctttat

SEQ ID NO: 1567 - DNA, 81 bp; double-stranded, linear
aatggatgggacagcaattagtgcataacgacaatatatgctcaatttgtcggcaactggttaagaatcgtattgtcacaa

SEQ ID NO: 1568 - DNA, 80 bp; double-stranded, linear
aatggattcagtaggtattggtgaagcgccagacgcagctgatttgaaagatgaaggttcacatacttttagcatacctt

SEQ ID NO: 1569 - DNA, 95 bp; double-stranded, linear
tttttaaatacgattttaaggaggccattataatggcgagtaaaagtagcgaattaatggttttggttaggaattggtcgtttaggcattcagga

SEQ ID NO: 1570 - DNA, 118 bp; double-stranded, linear
cccaataaaaaaagcctgttgtcacaatggtcatagacacgtacatactttaaaggtttctgtaatataaatatttcatatgccactttaaagttggnacgttcgtatgttgtactaa

SEQ ID NO: 1571 - DNA, 104 bp; double-stranded, linear
gacttgatcaatgaagcattgtgtgacaattggtctgtttgcacaccgcacggattgngcgtcatttatttgtactaattcaaaaaacattgttgttttcctag

SEQ ID NO: 1572 - DNA, 118 bp; double-stranded, linear
ccgaactgtaatggtcctaatgttttactcataccatattgcgtaaccattgagcggcgattgtgttgcacgtcgagcattgagaccgttgtactcgtaangtatatctctgtacacg

SEQ ID NO: 1573 - DNA, 74 bp; double-stranded, linear
agggatcaaaggtccatcccccatgcattggatagtgggggatgacttttgatcctatgttccagttgcttatt

SEQ ID NO: 1574 - DNA, 341 bp; double-stranded, linear
aaccttttgagtaaattcaccaatactcatccccttatcatttaacaaacttttattaatgtttttggttatattatgagtctttactgcttttagattgtaaaaattatcgtcataaatagtggcatcttccgagattcaaatggtacaaagtacattgtaatatgcataatgatacctgtaattaatgtaataatagaaaagtgtatatatctcatatcgccacctgctatacaacttattaaataattaattccaagacatattaattatctaattataaccttagttnacgttattacataatataaaaatatataataacttatccnccggcncct

SEQ ID NO: 1575 - DNA, 109 bp; double-stranded, linear
acgtgtaccaacttttgggcaccattgataatangtgtcatagggtgactcagcataacgggcaagcctattaatgatagccagattaagacatacagtacatatgttc

SEQ ID NO: 1576 - DNA, 79 bp; double-stranded, linear
gctagattgcgggaattaacaatcatcagcgatttaatatttgcactggagacgtcatggtaataaaaaattgatgaga

SEQ ID NO: 1577 - DNA, 69 bp; double-stranded, linear
atgatggctatcatgagattgagatgataatgacaacagttgatttgaaatgatcgtgtaacttttcat

SEQ ID NO: 1578 - DNA, 104 bp; double-stranded, linear
aaattgtcactncaggtcataaccaaccaggtgggactgcacgagcgttactaatgatccaacggtcttgctttgtgatgaggcaacaagtgcacttgatccgc

SEQ ID NO: 1579 - DNA, 89 bp; double-stranded, linear
gctcaatagatacaactattaggacaacggactatcgtttacaatttattccagataaggatcgcgcaggtcgtatgcgtaactatgca

SEQ ID NO: 1580 - DNA, 102 bp; double-stranded, linear
ttgtctctaataatggntttggctttttctaaaatttcagatgtgggtgctggtgaagcaccgactggttaattttcttgtcgtcacggccactttttgttt

SEQ ID NO: 1581 - DNA, 102 bp; double-stranded, linear
aaggtgctgttattaggataatgnatttaaaccccatggtatgaaggatatctggaagttagattggatatcccttaaccatggggggttttatttttgggg

SEQ ID NO: 1582 - DNA, 160 bp; double-stranded, linear
ttcaggggagctgaacatattgacgacttttgggtcaattcattttgcattttacttttaaatgcgttgttgcatgtaattgtattaacgacatacatggtggggctctaaatnaatgcttgactaatttcttggatggagaccacgatttaccaactca

SEQ ID NO: 1583 - DNA, 348 bp; double-stranded, linear
taaaagcaagtacattagaggttagatcacaagctactcaagacttgagtgaatattataatagaccgttctttgagtatacaaatcagtcaggatataaagaggaaggaaaagtgacgtttactcctaattatcaacttatagatgtaactttaactgggaatgaaaagcaaaattttggtgaagatatttctaatgtagatatatttgttgtaagagaaaattctgatagatctggtaatacagcttcaattggtggtattactaaaacaaacggttcaaattatattgataaagtaaaagatgtaaatttaataattactaaaaacatcgatagtgttacatcaa

SEQ ID NO: 1584 - DNA, 73 bp; double-stranded, linear
agccagcagtagatagatatattaatgaattcttggagaaaggtagctcaaattgtccaattgagatattgaa

SEQ ID NO: 1585 - DNA, 255 bp; double-stranded, linear
gtaaggaatggtcacgtattccacacttctatatgaattattatgtatatcaatacgcaamtggttacagtgcagctcaaagcttaagtcatcaaattttancagaaggtaagccagcagtagatngatatattaatgaattcttgaaaaaaggtagctcaaattatccaattgagatattaaaaaatgctggtgtagatatgacaacacctgaaccaattgaacaagcttgtgaagtttttgaacaaaaattga

SEQ ID NO: 1586 - DNA, 400 bp; double-stranded, linear
ttattaggtgantccattggcaacattgattggtttgtcattaggacaaattttattatacattggcgttatttttactatcttatctggtattgaatacttttataaaggtagagatgtttttaaacaaaaataaatatttgtttatactagatttcattttcatatggaatctagtttttttaatcccaattttagaaattagccacgcaattgtttataatgatatattgtaaaacaatatttgttcatttttttagggaaaatctgtagtagcatctgatacattgaatctaaaattgatgtgaatttttaaatgaaatacatgaaaaaatgaattaaacgatacaagggggatataaatgtcaattgccattattgctgtaggctcagaactatt

SEQ ID NO: 1587 - DNA, 561 bp; double-stranded, linear
caaagcgtctattattgtttgattttgatgaaacatattttaaacataatacaaatgaagaagatttaagtcatttaagagaaatggaaaaattgttggaaaaactanctaataataatgaagtgatcactgctgtattgacaggaagtacatttcaaagtgtcatggataaaatggatcaagttaatatgacgtttaaaccattacatatcttttctgatttgagttctaaaatgttcacttggaataatggcgaatatgttgaatcagaaacatataaaaagaaagtcttgagcgaaccatttttatttgaagatattgaagatatattacgtcatatttctgcgcaatataatgtcgaatttattccacaaagagcatttgaaggtaatgaaacacattataatttttattttcattcaacaggtaatcacaacaatgatagtcgtatcctagaagcactnntcagatacgcaaatgaccaaaactatacagcgagatttagtcgaagcaatccattagctggtgatcctgaaaatgcgtatgatattgacttcacac

SEQ ID NO: 1588 - DNA, 79 bp; double-stranded, linear
ccaacagttttatcattatggcaagttctgttaaacctgctgagagttattttgcactgattgcaaaaccagaaattgg

SEQ ID NO: 1589 - DNA, 73 bp; double-stranded, linear
gcagatatgcagcaatttatagaggactagtaaacgcatatatgacttacagctttcagacaaatagctttgc

SEQ ID NO: 1590 - DNA, 71 bp; double-stranded, linear
tcattttatggttgatcataggcgtcgtctttttccttggggattttatctttaaatacacagattggcgc

SEQ ID NO: 1591 - DNA, 78 bp; double-stranded, linear
atacaatacaattcacaccatatatggataaaatgcaagatgcaattactgcagttgcacagtgcaagtagcaatacc

SEQ ID NO: 1592 - DNA, 168 bp; double-stranded, linear
ccaattaattaaaaaccggaaaaccaattttttaaaccaattaagttaaaaattttttaaaattgggccccaaaccttggaaaaaggtttaattttcctttcccaattttcccaaaatttttaaacccaaaaattcccggttttgggttaaatttccctnggttaaat

SEQ ID NO: 1593 - DNA, 117 bp; double-stranded, linear
tgctagaaagtatagaacctggttcaaacgcatggttttatgtccctttttaaacngatgtttattaaaaaaatatggaaattggccacgtccgccaatttccttagaaaagaacgt

SEQ ID NO: 1594 - DNA, 66 bp; double-stranded, linear
agacgaagccaaaaagttattcgccaaatctgaaatattttcaaagaccttaaaggcgtaaaatac

SEQ ID NO: 1595 - DNA, 100 bp; double-stranded, linear
attttatttaggccaataactgnctacttctgaaataagttgctttgcatagtctgacgcgggatgtttggataatatcttctgtgttattgcattgcaa

SEQ ID NO: 1596 - DNA, 73 bp; double-stranded, linear
gaccagacggccgtaaacctggatgaaaccgtccattagattctgaagttggtattttacctagaacgcatgg

SEQ ID NO: 1597 - DNA, 66 bp; double-stranded, linear
ctttataaaattgtctttgactaacaggattttcaacgctattcacaaaccatggtttaacatatt

SEQ ID NO: 1598 - DNA, 139 bp; double-stranded, linear
tatggcaccctctttgatnttgtgaccgtttttggtaattcaccattattgtacgaaccatggaattcgctgccttcctttaggcaataacataattatatttatccccttcttgtcactagaggtgctgacaacacca

SEQ ID NO: 1599 - DNA, 101 bp; double-stranded, linear
ctcctctgcatgcacatcttgttgtagcaaggttcacatgtaatttattaaatcgaaactctatccaactatgttataaagttcattctaaacaaatnagt

SEQ ID NO: 1600 - DNA, 172 bp; double-stranded, linear
ttgtaccaaggttcacatgtaatttattaaagcgaaacgcgtatccaactatgttataaagttcattcgtaaacaaataagtataaaaattcaatatttttattactagaatatggttaaatacatttatttcttataanaatttgatgtttaagatattttgccaaattga

SEQ ID NO: 1601 - DNA, 112 bp; double-stranded, linear
ttggcactggccgtcgttttacaacgtcgtgcactgggaaaaccaaancacgacgttgtaaaacgacggccagtgccaagcttgcatgcctgcaggtcgactctaagaagga

SEQ ID NO: 1602 - DNA, 679 bp; double-stranded, linear
tgcaatggttaatcatctcatataacaacacataatttgtatccttaggaggaaaacaacatgacaaaacattatttaaacagtaagtatcaatcagaacaacgttcatcagctatgaaaaagattacaatgggtacagcatctatcattttaggttcccttgnatacataggcgcagacagccaacaagtcaatgcggcaacagaagctacgaacgcaactaataatcaaagcacacaagtttctcaagcaacatcacaaccaattaatttccaagtgcaaaaagatgggctcttcagagaagtcacacatggatgactatatgcaacaccctggtaaagtaattaaacmaaataataaatattatttccaaaccgtgttaaacaatgcatcattctggaaagaatacaaattttacaatgcaaacaatcaagaattagcaacaactgttgttaacgataataaaaaagcggatactagaacaatcaatgttgcagttgaacctggatataagagcttaactactaaagtacatattgtcgtgccacaaattaattacaatcatagatatactacgcatttggaatttgaaaaagcaattcctacattagctgacgcagcaaaaccaaacaatgttaaaccggttcaaccaaaaccagctcaacctaaaacacctact

SEQ ID NO: 1603 - DNA, 85 bp; double-stranded, linear
cattttaattgatataatttagactttaacatttcatgctgttcacggttttaatttgagacgtcatttggtataacaactatac

SEQ ID NO: 1604 - DNA, 68 bp; double-stranded, linear
actggtgtgaatagctccagcaatttctttaaccgcgatcataatcaacgtcaccttttaatttgcca

SEQ ID NO: 1605 - DNA, 109 bp; double-stranded, linear
tggggggtntttttgggttgggttaaaaaaagggaattggcccaaggggggaattcccttaaaaaaacccccaacccccttgggaaattaaaaattgggttaaccggga

SEQ ID NO: 1606 - DNA, 112 bp; double-stranded, linear
gcttatatacatgttccattataaaaggagtacgaacgaaagtaacgcatgacgttaatttaaaaatattgtaataattatggattaaatttaaaaccanggggtattccat

SEQ ID NO: 1607 - DNA, 106 bp; double-stranded, linear
ctataatcgataagatcggtgaattcgtatgatcttatctacttgaccgtgctacaatcggttcaagttggtaacctaacaacacgnaattagtttaaacgtttgg

SEQ ID NO: 1608 - DNA, 83 bp; double-stranded, linear
cacactgataccataggatttatgatagatcaacagcatgaccaaatgtatgacctaaatttaaaaatttacgtacaccttgt

SEQ ID NO: 1609 - DNA, 132 bp; double-stranded, linear
aaaagaataaagtcactgaacaatggtctttcacaatgatgttgcgtcaatgcacaagcgcattatgtntgtgacttgggcattttggcttatcagctgaatattatacgcatttacatcccaattaacgta

SEQ ID NO: 1610 - DNA, 107 bp; double-stranded, linear
tttaatgcatacgcttctcgcttagcaatttctttgcacgtctaacaagcattaacgctcttantactataatcacaacaaaaccagcgaaatataacatgcgtata

SEQ ID NO: 1611 - DNA, 84 bp; double-stranded, linear
ttcgcacctggtatcgttcaaaccaccaatgatggcccgtctcgccgtggcaacagccgaagaccgcaggtaaaccctgaacgc

SEQ ID NO: 1612 - DNA, 127 bp; double-stranded, linear
actcacatgtacgataacacccttcgtaaatccatctttggtttgccaagttcgtcgttgtaaactgtctatactcgttaaaccgctacatgttttcctaaancctgtgcctaaatgctttactgaa

SEQ ID NO: 1613 - DNA, 129 bp; double-stranded, linear
cgttcaactttttcaatttctaacggcgttttactatctttatctgtaactaattcaactccaaacattaagcctcgtcctcttacatcaccaacatttcgatgacgcttcagcgcatgtaactgtttc

SEQ ID NO: 1614 - DNA, 348 bp; double-stranded, linear
ncaactagtggatttaanatanacataattataaatgcaaatgctaatagctgaataccctttattttaatttgcttagtaataaccagtacaagagttgtcattattatagctcttacagcactaggtgcataatttgtgtattgagcaaataaagctaatacaatgattgtaattcctttaatgacaaataaaggtaaatttaatcgttttaaaggttggtaaattaaaaatacaattgcagctatatgcgagccactaactgccagcaaatgatatatacctatctctttaacacgttccttaaattgctcattaacttcttttacgtcaccagtaatcaatgcc

SEQ ID NO: 1615 - DNA, 72 bp; double-stranded, linear
gagctccaccgcggtgtcgcccgctctagaactactggatcccccgggctgcaggaattcggcacagcatat

SEQ ID NO: 1616 - DNA, 63 bp; double-stranded, linear
catcacgttaaatcataacgcgtgacgtgcttttgctatttgtctctcggtatctctatatct

SEQ ID NO: 1617 - DNA, 113 bp; double-stranded, linear
attgaattcaagggtggaactcatgaattggctggaaaaaggtagatttaactggatggttgnagccatatatcggtgcgtttatttatttggtattttaaaaatcaacctcg

SEQ ID NO: 1618 - DNA, 80 bp; double-stranded, linear
gtacaataaagtggtaaacaacatgccaatggaaaaagggattaaaggtgtttatgtcattcttaaagatagtaacggta

SEQ ID NO: 1619 - DNA, 117 bp; double-stranded, linear
atcttatgtttttttcctaaaacttctgctacttcatttatttgatgtatggtagataattctgtttggatactcatatcaactttttctatcatatctgaaatctcttttntggca

SEQ ID NO: 1620 - DNA, 107 bp; double-stranded, linear
cgataaacccttcgtaatcaatctttggtttgccaagttcgtcgttgtaacagtctatatcgttaaaagctacatgntttcctaagcctgtgcctaatgctttactg

SEQ ID NO: 1621 - DNA, 63 bp; double-stranded, linear
aatatcgtgtctctgtccagtgctgtccaatcaattttgatccaccgattgtcatacgtaatt

SEQ ID NO: 1622 - DNA, 75 bp; double-stranded, linear
accatctgacatcatcaattatgaattaatgatgatattaaaaataaatttgaaacattgccaattgatagtgcc

SEQ ID NO: 1623 - DNA, 78 bp; double-stranded, linear
tacctgtgtatcagctctattaacaacctaacatatgtgaataatttgcgatccttgttgataatgctgtaatttgac

SEQ ID NO: 1624 - DNA, 95 bp; double-stranded, linear
gcaagcttttgcggcttctgatgcaccattaacttctgtaattaaacacacaaagtgaaacaggtaggtaatgcaaaactgcaacggacaatcga

SEQ ID NO: 1625 - DNA, 76 bp; double-stranded, linear
attgcgattacacagtagtgaatgagatatttgacatgaaagctcctgcagcttctaaagaagagttagcaggttt

SEQ ID NO: 1626 - DNA, 126 bp; double-stranded, linear
aaaagctaaaaaagattatcaggtgtatcacaaactcaaattctcattaccatttatctcagtgtgaacgtcttaattgagaactaatctnaattgagatattagtcatataaggatggacaagca

SEQ ID NO: 1627 - DNA, 116 bp; double-stranded, linear
tgatacgatagaacatagttcagcacattgtttgttgaaattggatattaccgccattttttcacaatatcaataatacctgaacgtgttggttnttccacattatgattgtacat

SEQ ID NO: 1628 - DNA, 91 bp; double-stranded, linear
attttgtcctatcttgaacaaatccgatttttctcagacactgaatccaaagtattcatgtaccataaaccatctgcatgttgatttatgc

SEQ ID NO: 1629 - DNA, 400 bp; double-stranded, linear
acagaaagtcaaacagtaaaagcggcagaatcaactcaaggtcaacacaattataaatcgttaaaatactactatagcaagccaagtatagagttaaaaaatcttgatggtttgtatagacagaaagtgacagataaaggagtatatgtttggaaggatcgaaaagattattttgttggcttgcttggtaaagatattgaaaaataccctcaaggtgagcatgataagcaagatgcatttttagtcatcgaggaggaaactgttaatggaagacaatattcaattggtggtttaagtaagacaaatagtaaagaatttagtaaagaagtcgatgttaaagtaacaagaaaaattgatgaatcatcggaaaagtctaaagatagtaaatttaaaattacta

SEQ ID NO: 1630 - DNA, 400 bp; double-stranded, linear
gctttccttttcgaaatctataaatctaatccattgaagtaaactaattatgataattattaattctataattgtngttatctttaaataatttggaaacctttcataatctaaaccaaaaaagaaagttagacatgaaaaaagtatcataaataatgatgctaaacttaaggcttgtgcacctggctttcgaagaatgtctatattttccttagtagtcatatttacctatctcctatacattgattttgtaatagcatattaagtatttaaagttataagtacttagattcttttcgattaaaagtataaaagcctaaaattatctttatattattatttgatgacaactttatggtctctattgttttttacttaaacgctaaaaagctanacaaag

SEQ ID NO: 1631 - DNA, 70 bp; double-stranded, linear
acagcaatgtttgggcaaccagaagtatatttaacaataaaaaaagttaaaccaagattatctagagcga

SEQ ID NO: 1632 - DNA, 62 bp; double-stranded, linear
caacgaagatattcaagtgttcagtcattatttttgactgctaatgaaactgattcttgtgg

SEQ ID NO: 1633 - DNA, 81 bp; double-stranded, linear
ctaatgattagattcaaactaataaagactacaaaaacaagttgataatggtaaagatattatccaacttgacatctaaag

SEQ ID NO: 1634 - DNA, 63 bp; double-stranded, linear
aatttcacctttgtctagtaatttatttgtgtagtgtaatcattaattgttttaatatctagt

SEQ ID NO: 1635 - DNA, 579 bp; double-stranded, linear
accaactagctaaatgccagcgcggnatccatctcanaagtgcacagcaagaccgtctttccaacttttgaaccatgcggttcaaaatattatccggtattnagctacggtttcccgaagttatcccagtcttataggtaggttatccccagtgttactcacccgtccgccgctaacatccagagaagcaagcttctcgtccgttcgctcgacttgcatgtattaggcacgccgccagcgttcatcctgagccaggatcaaactctccataaaaattatgatgtttgattagctcataaatactaaataatgtttgtaactaatagttacgtttttggaattaacgttgacatattgtcattcagttttcaatgttcattaatgttcaatctcttttattctacttcatttatttcttgaagtcaataactttttgaacgattactttatttattctatattgtttttatagttatttcaatggtaagtnttacacttttgaaattcttctttaaaaacaactgcgtcgtttttgacgctttatcatattatcmactttgggaatttaaagtcaataac

SEQ ID NO: 1636 - DNA, 69 bp; double-stranded, linear
tcgacattaagcaacgttcttcgcaaaaggtagcgagcgacacgagttaactttgcacgtttcattatt

SEQ ID NO: 1637 - DNA, 116 bp; double-stranded, linear
ctgtgacttcgtcgcgatgaccttcgccgttgttctcatggtaagctttaagtatcgtcgatgcagtcngttcgccatgtgcgccagcagactggttgtaatgtcgcctcgtccgt

SEQ ID NO: 1638 - DNA, 71 bp; double-stranded, linear
acaacatttaggtactttcacgcatatcactacagctcaacgtgatgatttaccaaatcaaatttcacaag

SEQ ID NO: 1639 - DNA, 73 bp; double-stranded, linear
gcgtggctttgtgattaacattgacaagcacgtgcaacaacatattcgacgcgataaagcgacatctaatatt

SEQ ID NO: 1640 - DNA, 400 bp; double-stranded, linear
cgcgatcattttcatttctaattaatcttccaagtccttgtctaaaacgtgtaactgcatcaggtaatacatattccttgaaagttgaagtgaattcagaatccataagccaatattttgcattatgcttgttcataaacggtaacttcgctatcatcacacatttaataccatttgcttgaaaatcaaaaccttcaaaaaatgttgacgtaccaagcagtatggccttatcaaaattattaaactgttgtactattttataattttggttctgctgttgtgttaatacaacataatcttcaaattctggcaattcatttaagcatatcttgtaccatatgcatcattttataactcgtaaataagactaaacattttgatgacgttatagtcgtatatn

SEQ ID NO: 1641 - DNA, 66 bp; double-stranded, linear
attgttgtaccatgtatactaacaattgtaatgtctcatttcagtaaacaaaaagcgaaagacatt

SEQ ID NO: 1642 - DNA, 400 bp; double-stranded, linear
atttcgtcgggaataaattttgccattacatagaaatatctaatagataacgaaaaagtatcgtatgtatttttaatatagtgtaaaatattatatgtaaaataaaatgtaggtttttagttagaggcattataaganaattttgagtataggttagcttttaattatgaatcttattgaaatttgattaataaaaatatgataggggattaaaatgaaactattttatatcgtatttcttattattatatggctgaatatatttttaggaaatgaaatcatccatacactgactgttttaataacaacattgtatattgttaattcacganaggggattaaaaatgacagagttgaataatattataaacgcgcntgcaatcnttgtttgagtccggaa

SEQ ID NO: 1643 - DNA, 66 bp; double-stranded, linear
aactagaggaggacatcctaatggaagcaaaacccgttgctagaacaataagaatcgcacctcgta

SEQ ID NO: 1644 - DNA, 75 bp; double-stranded, linear
tatcaatttcatatgcgatttggccttgcaataattaggtctcaccttgccatatctttacctaagcaatacttg

SEQ ID NO: 1645 - DNA, 70 bp; double-stranded, linear
cattctcctgcatcataaaaatcaacaattgtatcatcaaagtgtatcaaaatattttaatatcccaatt

SEQ ID NO: 1646 - DNA, 73 bp; double-stranded, linear
agtgacactttcgttccaccacatcgtaaagaagtacttcaagcacgtgaagatgacatcaaagaaaaagttg

SEQ ID NO: 1647 - DNA, 71 bp; double-stranded, linear
ctgtgattggtgttgtgattgtcttgcttcctggttgtccttcttgtttcgctcgctcttcgccgggttgt

SEQ ID NO: 1648 - DNA, 115 bp; double-stranded, linear
aactatagaaaaattcggaattataccagaaatggaatatgaaatggaagaggttaaacaaancgagcaatatattagagagcaagaagaagctggaacaatagaggcgataaca

SEQ ID NO: 1649 - DNA, 59 bp; double-stranded, linear
tgttgtcatgatctgaaaagtcaaagtcaatagaacattggctttggctttttatttgg

SEQ ID NO: 1650 - DNA, 125 bp; double-stranded, linear
accgataatagtacacggcataatgnaacaacttggcatgcaccctttttacgttcctttatctctgcatgattgtcatgttcatcatggtttggcttgcattaatagagagggttgacgcagaa

SEQ ID NO: 1651 - DNA, 71 bp; double-stranded, linear
tgattaacgcgaatgccacttttactaccaatgttcccaaagctgcttctgacaaacgccattgtactctg

SEQ ID NO: 1652 - DNA, 60 bp; double-stranded, linear
tcactacatgcaccataaatacagtatgaacgtattgaaatgggcattacatgatacaga

SEQ ID NO: 1653 - DNA, 123 bp; double-stranded, linear
ttaattgaaacaattgacaaatgcaatttgacgccaaactttgaactttgaatggattatcacattatgattgttcatccatggncaattagcatggacgtattacattctggattatcaagc

SEQ ID NO: 1654 - DNA, 76 bp; double-stranded, linear
ctatgacgtcgcatgcacgcgtaacttgggcccctcgagggatcctctagagcggccgcccttttttttttttttt

SEQ ID NO: 1655 - DNA, 145 bp; double-stranded, linear
ccataaaagaantaccgatcatttagccaagcgaaaagtggcttaatacaggtgtagcgattttaaattttcgtgaaatcggaaatgtacgattagttattaagcgttagaatgtgtgatatgtgaacctggtattgacggcgct

SEQ ID NO: 1656 - DNA, 73 bp; double-stranded, linear
tttagaattccaatacgctattgccagcgatttagccacttgtgggtaatgatattgaaggtgttagtcaagt

SEQ ID NO: 1657 - DNA, 93 bp; double-stranded, linear
cttctgaaaagtagtaatgtaacctattggatgcgaatgaatccccaaatttagtggacgtatgtggcttcatcttcagaacctgtatctggt

SEQ ID NO: 1658 - DNA, 58 bp; double-stranded, linear
aagttaacatgcaagttgacgatgtaatgactcaaaaagagtggaaacaaaaacacga

SEQ ID NO: 1659 - DNA, 65 bp; double-stranded, linear
ttaatcccacaaacaaatgtatgaaattgagtcagtgatattaaatatgggcttgaaagtgtcta

SEQ ID NO: 1660 - DNA, 91 bp; double-stranded, linear
tgcatttttgtaagaacgcaaagcattgtaaattagtttttataaattaggatattatcatgtgtattgaaaacaatgaagtgtgctatga

SEQ ID NO: 1661 - DNA, 60 bp; double-stranded, linear
acatatctgtccacacaacaaggaccatttgtctgaagggacagtgagtggggaatatgt

SEQ ID NO: 1662 - DNA, 169 bp; double-stranded, linear
tggggttttaaccaggggacctaaaaccagcccccattttccaagtttggaccccaaattcccnaaatttaaaaaaaatttgtttggggtctaacttgggccggtgccttcctgcctaaatttagcccatgtctaacatagtactttgggaacgtaaaagtttaattta

SEQ ID NO: 1663 - DNA, 677 bp; double-stranded, linear
tggcacaattgcaccaattaaatgaataactttatcatttttatatacaggtacaacaatcgcttcttttacgaactcagactggcgtaattgtgtttcaatttcttctaattccattctgtagccattcaatttgatttggaaatcaatacgaccttgaatgaaccattgaccattttcaaacttcgctttatcaccagtgtgatatgtacgaataccgtcatcgaaattaaatacttcagctgttttttggtcattttttaagtatcctaaacttacactttgaccttcgataacaagttcaccttcatctgtagtagataatcttgcgcctggtctttcaacgccaacaggtaatgtcggatattgatctaagatttcttgtgtaatttgaatacttgtaactgctaccgtagcttcagttggaccatatgtgttgtaaatcgtcgcacttgggaaacggtttactaacgcttttgctgctctgtgaggtagaatttcaccacagaagaagaattcgttaagactaccatattgttcttcattaagcgttggtaataataaacacatttccataaatgatggtgttgatacccaaatgttaatcggtgttgctgttagcatttcatttaataatttaggtttattaatcatgtttttatctacaagantnaang

SEQ ID NO: 1664 - DNA, 62 bp; double-stranded, linear
gttacaacaatagtggtataaaacgggagcaattagagatcaatatatgattattaagagca

SEQ ID NO: 1665 - DNA, 342 bp; double-stranded, linear
gagtattatagcaaatgatattaaattgatatgatgatnttgnagcaatatctacacctagtttacgcaaatgatagctcggtaaaacatgagcaacatgttgaagccaatttggaaatgtgtttatcggaaaccacaatccacctaatactgctaaaccaattgttacgatattagctaaagcacttgttttttgaatatcatttaacaaagaaccataatatgccaaaagttattaatagagacgcacctaaccataaaaatattcctgactctaaccattgaactgcactcattgcaacacctttataaaaatgtccaaccataaaaataactaatatc

SEQ ID NO: 1666 - DNA, 102 bp; double-stranded, linear
gtccaagaattcaaaaacgttttcaacttcggccaaagcccaatttntctttgtggtttaactttttaattttgaacgttttagggcataaaaaaaaaaagg

SEQ ID NO: 1667 - DNA, 122 bp; double-stranded, linear
ttgatagtagccataatcataccacttaaataatatgtttgatcatcggcataatttttatttattgtctgttcgcaatattttgagcattatcataattaccactagtcatatcatctttg

SEQ ID NO: 1668 - DNA, 57 bp; double-stranded, linear
agagatgaaattaaaatcgcaattgaaaatttcaaatcacgatgagagtgggacaga

SEQ ID NO: 1669 - DNA, 70 bp; double-stranded, linear
aactactgccaatattaatagcattggtacatcttagaggcattgaattccttactcagactcataatgc

SEQ ID NO: 1670 - DNA, 73 bp; double-stranded, linear
ttgtctgatataatccatttcgattggactccacacgttacaccgataccttctttaccagcccgacccgtac

SEQ ID NO: 1671 - DNA, 140 bp; double-stranded, linear
gaagaattgtactgttaaagtgactctaaactatcgcggaaataacagtgaaatcaccaattagactagcgacactgaagtcattaaaaacagacatttgtagtggtgcncttatcaccgcaaatacaagagagtttctc

SEQ ID NO: 1672 - DNA, 59 bp; double-stranded, linear
aacaacgtttactattggcacagaacggttggtacttagtctaataccattgtcatcaa

SEQ ID NO: 1673 - DNA, 124 bp; double-stranded, linear
atctctttgacttgaaggattggatttaaatcttggtgatttgggccgtgaaatatttccagaaaattcctcagacgtattagtataattgtaacgntacattctaatatacctttcttcgatg

SEQ ID NO: 1674 - DNA, 109 bp; double-stranded, linear
caccaccaccacacacacacacacaaacacacaacccccccacacacaaaccacaccaccaacacaccaacacancacaaaaacccaccacacacaccacacaccaacc

SEQ ID NO: 1675 - DNA, 101 bp; double-stranded, linear
tngtcaactgatttatgaaatggcagagcatatggcgtcaaaggttcttaatcgttaagccagaccactggaggaccattagatgcagcgttgctttcaag

SEQ ID NO: 1676 - DNA, 400 bp; double-stranded, linear
tttttaaaatttgnaaattttagaccttatttcacgtgcgatttaatcgatgtgttaataaaacaatactggcattcaacatgtaatccgataataaaataaggttgcaattatgttattgcatattttgtttattacttagaataatacgatggttaagatgaaatatatgacaaagataaataatgacattaaattcaagatgtttacgccttttagatcttttttaagcattttaaatcctgtcacttckacattaccgactaagagtaataagacgataaatacccaccaattstcttttggaaaactcatcgtcgttaatgctaagacgaataataacaacacacccataataattctcaaaatgcgagtaaatacaacttccattttaaaaata

SEQ ID NO: 1677 - DNA, 64 bp; double-stranded, linear
tcttactcatgcatatgagtgcaagggcctgagcattcatcagcaagattagagcgatttttac

SEQ ID NO: 1678 - DNA, 65 bp; double-stranded, linear
acagctgatttattaaatgatactaagtccaaaggcatgcgcattatatcagttggtacatttca

SEQ ID NO: 1679 - DNA, 362 bp; double-stranded, linear
agcgccaccaactgacgaattaggtggtagttggacactatggaaaaatttagcgcgacaaagtcctgaatttggtaatcctgataagttttgccaaaatattcctanaaaaagttggtttgtttcagcaacttctacaacaaacaataaagagattatcgatacaatagaaagtatttgtaaacgtgacccacttggcaggcaaaacagttacaggcggtattattacaatcaatgattctgcatggcaaatgagttttacaatcaatcgtgcagcaacagtttgaaagaccaacctggaaaatggaaatatctacatggggtttgatgccttatgattcnggngtaaacggcggttgatg

SEQ ID NO: 1680 - DNA, 69 bp; double-stranded, linear
agatacttcagatttagcatcatgaagcaactttaaaagcaatcgctgacgctggtattcagcccgagg

SEQ ID NO: 1681 - DNA, 56 bp; double-stranded, linear
taaccatttcttttgacgttttatgttgttttaagaaataaataccagttaatgta

SEQ ID NO: 1682 - DNA, 56 bp; double-stranded, linear
ttgccaaatggtcacatataatcatacaccacggaaattcgagcgattaaattatt

SEQ ID NO: 1683 - DNA, 109 bp; double-stranded, linear
ccccaacacaacaaacaacacacccaccacccaaccccaccacacccacccaccaccccaacccaccacaacaccacncaccaacacacaccacacaacaaccccacac

SEQ ID NO: 1684 - DNA, 62 bp; double-stranded, linear
attatgttcgcgataatttaagtaaaagaagcacagatattgaatttgataggagtaattgt

SEQ ID NO: 1685 - DNA, 57 bp; double-stranded, linear
cataaggtacttaaattaaggcatatctgctgtctagcagtcgcataaatcattaga

SEQ ID NO: 1686 - DNA, 56 bp; double-stranded, linear
aaatggattgtttagtgcatatcgtaacatatcttagattttgtctatcattataa

SEQ ID NO: 1687 - DNA, 110 bp; double-stranded, linear
ctttatagtatattgctttttgtttttctttttcgtcatatttcacttttaaatagatacctgcaacactaattaatatgattaacataatactagttaatattaanatt

SEQ ID NO: 1688 - DNA, 214 bp; double-stranded, linear
aattactagtctgcttgtccaaagattatttatattctagctcaacattaatttctttgattttggtaccatctatcgtgtcacccatgcgatgcggttgtagtttttttgtaagttcgaaagtataaaacttatcatcttccattttaactacaattttaccttttctattattaacagcaccatataatttttcttcttccatcaatttttt

SEQ ID NO: 1689 - DNA, 59 bp; double-stranded, linear
gctagttgtaacgtgctttttcaccaccagataaatcataatatcttttaacatctctg

SEQ ID NO: 1690 - DNA, 55 bp; double-stranded, linear
ccaaactttataatatgaaatgcttggtaattacaaagataaaatcatactcacg

SEQ ID NO: 1691 - DNA, 64 bp; double-stranded, linear
tagacagcaatccattgctataggggtggatatctcatttgcgtttggagctgtgcttgttatg

SEQ ID NO: 1692 - DNA, 57 bp; double-stranded, linear
tgcatgggattgcagctaagagaatcataaaaatatattactttaataagtgtagta

SEQ ID NO: 1693 - DNA, 74 bp; double-stranded, linear
cgatgtgtacgtctcacctgatttcgcacggtaagctagtgcatattcagcaccgctactcgcccagcctagac

SEQ ID NO: 1694 - DNA, 162 bp; double-stranded, linear
aacttttcagatgttgatagctatagatttaggcgctattcaccangtctacatgcaatacgtacgttataatgcactgcaacgaatcgcgcgttatgagttggtaattgttgttcaatattgggtgtatagttttcaacgtggttacaagcaactacctaa

SEQ ID NO: 1695 - DNA, 55 bp; double-stranded, linear
aattatctctacaccttttctttcacataattgacgcaatataatccctatatct

SEQ ID NO: 1696 - DNA, 56 bp; double-stranded, linear
atgcaacgttggcattgggaaatggtcctgcctaaattaacacgcaataaaatgtg

SEQ ID NO: 1697 - DNA, 57 bp; double-stranded, linear
actgtgtagaagatgctattattgtaaaacatagttttaattttattttctgatata

SEQ ID NO: 1698 - DNA, 109 bp; double-stranded, linear
aaaattttcccccgggaacccggttttttaaaccccccgttttaaaaaaattttggggggcccaaaatttcccaaaaaaanaaaaaattttttttttcccggggaaaaa

SEQ ID NO: 1699 - DNA, 100 bp; double-stranded, linear
gtgttaacgtggattatatcaangaggcggtcaggtacagtccacacgcacagcgcacagaagtatcacatccagtaaacaaggctagtacagcattgca

SEQ ID NO: 1700 - DNA, 129 bp; double-stranded, linear
aaggttaaatgaattaggttgatcaatgctctatactcattgctaagtcaacgcacctttaccaccttttcccaactcagtaaggcattcgacgtatttcttagccaagnttacatatctactctgcac

SEQ ID NO: 1701 - DNA, 63 bp; double-stranded, linear
caagaggaacaactcggtactgcgcatcagcagagatggcgaaatcacacttagaagacaagg

SEQ ID NO: 1702 - DNA, 400 bp; double-stranded, linear
tatttaataaatcttcaataccttgttcatcagtttgttgataaataagacctctccattttaaatcttcaattaatacattcgtcattattatttcctcctatttataattatttattgaatacttgttaaaatactttaaagktttttgaacgtaaaaaaaacccttacaacaaatatgtaagggcgcgattgcacgttaccaccaaacttaaacataatcataagataatgttcactctattaatgatacgttcattaataaacgtaggacatgttagttataaaggtgtattcatattattaaaaacactagttcacagcgaccactagctctctgatgatttcaaataatattacttgtccttttatcctattctgtatgcattttccctaatta

SEQ ID NO: 1703 - DNA, 208 bp; double-stranded, linear
tcaatattgatatcgaaacgctttgcagattgatataaattatcagaatcaagtaattcatttattttctttggtgaaagtacttggaaaatactatactgatgaaaacttaaaaatgaaatgaagtatggaagttgttgctttgggtaagcnaaatttctaatacatactgattaaactgtttgtttattgngaattgcaacgcatc

SEQ ID NO: 1704 - DNA, 67 bp; double-stranded, linear
aagccgatgtaattatttatgcaacacctgttctaatgcacaaagaaatatcttagcgagcttatag

SEQ ID NO: 1705 - DNA, 54 bp; double-stranded, linear
ccaacttgcatgttattttaagctgactttccaccaacttctgagtttgtggcc

SEQ ID NO: 1706 - DNA, 61 bp; double-stranded, linear
caactacacgaaagggtagtgcttcaagataataacgtccaattattaggaactgtggcga

SEQ ID NO: 1707 - DNA, 54 bp; double-stranded, linear
accattccaaatgaacctaaaccacttgatacgttgacgacaacaggttgttca

SEQ ID NO: 1708 - DNA, 59 bp; double-stranded, linear
aaatttgaataactgtacacatttttttgatcatagtctatatactttgtgaattaatt

SEQ ID NO: 1709 - DNA, 59 bp; double-stranded, linear
gcacaatagccaattagatggggccggtgcggtaacattttgcttcattcctgcattat

SEQ ID NO: 1710 - DNA, 55 bp; double-stranded, linear
ttacaattcaatcaagttcttcattatcagacgaagaaatccaccgtatggtaaa

SEQ ID NO: 1711 - DNA, 56 bp; double-stranded, linear
tttctgcttattgtcattcgatatcgaattattagaaagtgcagatttcgcatcag

SEQ ID NO: 1712 - DNA, 55 bp; double-stranded, linear
taaacctttaggattgctggcaatagtagtgcagttggctggacttgtcatgccc

SEQ ID NO: 1713 - DNA, 207 bp; double-stranded, linear
caagaggattcgtgcantgaattcatggagatatttagatctttcactggagagaaaataaaaagaagaaaagagtaacctttagattgctggatntgtgcagtggctgcttgcgtgcctttaggtggcataaggaggctatacgcagacaaccaccgtcccggggttttattgtacactgtgtaggacgcagactttatgtggttg

SEQ ID NO: 1714 - DNA, 84 bp; double-stranded, linear
tggttatcgactgctcgtatattttgactgttttgactgttgtttccgtagcaatactatctcctaagcctttcattggcattg

SEQ ID NO: 1715 - DNA, 54 bp; double-stranded, linear
gtttgaattgactgacttcgttttaccgcgtgtttaatattgttatacatatat

SEQ ID NO: 1716 - DNA, 77 bp; double-stranded, linear
gaagcctgtcagtggatcaaattattgaagataacttgggtggcatttttggaaagtccaaatgctgggaatggtca

SEQ ID NO: 1717 - DNA, 154 bp; double-stranded, linear
gggccctttttttcccaaaaaaaaaaacccccccaaccccaattttggncccccttcccctttaaaaatttaaaaattgggccaaaaggcccccccaaaaaaaacccccaattggaattggaaaaccattggaaccaattccattgaaccagga

SEQ ID NO: 1718 - DNA, 120 bp; double-stranded, linear
attgtctacactgccactttattttcattaaccatttcacaaatgtgttcatcattcaacatgaacatcaattgttcaattacatcgacacctgatgcctaancacgcaccttttgcaca

SEQ ID NO: 1719 - DNA, 54 bp; double-stranded, linear
ttcatttgtttgtaaaagtggcatttctatgtcttaaaagtgacgaaacttcac

SEQ ID NO: 1720 - DNA, 55 bp; double-stranded, linear
tgcaatttcatgaagactaacaccataccaagcgccataaacatttgtcgtcatt

SEQ ID NO: 1721 - DNA, 71 bp; double-stranded, linear
tttggattataaattgacatgtaagtacgaggcagctgtacccgatatataattgctaagagttagggctg

SEQ ID NO: 1722 - DNA, 325 bp; double-stranded, linear
ttttatctttattactaaaaccaactgcaccaaagtttgcagtcattaccacacgtttaacacccgcatgttctgcagctcttaaaatacgttgtataccttcaattgcaggcttcgccatcacttctgcatcgtctgttttaccgaaaaacaccggagatgctacactcaagacatacttgcaatctttcattgcttcatcccaatgtncatcttgtgataaatccgcttcgacaaacattaaatcgctctgtggaaatgcccatgtcttgcattgtttnaattactttatcagctttacttaaatcaagnatcgtcgtttgta

SEQ ID NO: 1723 - DNA, 71 bp; double-stranded, linear
cagtattgcagtcacgacaatgtgatgactaaattatccaaagtatgaattccatgcggcattaatcctag

SEQ ID NO: 1724 - DNA, 53 bp; double-stranded, linear
ttgcaacgatattaggctatctagtcggcatatttgtaaaacaagatccaatt

SEQ ID NO: 1725 - DNA, 71 bp; double-stranded, linear
atctattcatcttcgtacacggacaggaaatgagtccagtagatgcacattgggaattaatcgaagctagc

SEQ ID NO: 1726 - DNA, 71 bp; double-stranded, linear
catcttgcaggtctacattataaaatgtgaagttttctacgataacaattgggaaactcaggggcatctcc

SEQ ID NO: 1727 - DNA, 235 bp; double-stranded, linear
ttcntttttaaaaattccccattcctttttaaatttctttcccgctggattaaatggattttaaaaattccaccccaacttanaattaaatggcttgtggaaaattaacgggattggcattccattttaaatggcattctttccaccccatggagattaaaattttaagtttactttctttccagcttaaatggtttttttggaggcttccacgttaaaaatggcgggtggcttt

SEQ ID NO: 1728 - DNA, 61 bp; double-stranded, linear
tagagtggctataaagctaagttcaattgaccaatttacaacaggttattgaggacaataa

SEQ ID NO: 1729 - DNA, 54 bp; double-stranded, linear
atcaccaagaagttctaatgcttggtataaacgttgaatacgacgttcggtatt

SEQ ID NO: 1730 - DNA, 59 bp; double-stranded, linear
cgtcccgaagcgttggaggcgggaacatccagagtaattggcacagattatgaccatat

SEQ ID NO: 1731 - DNA, 60 bp; double-stranded, linear
tatggtagccccctaccattaatgcatttgtatgggatgtttagaccttttgttaatgaa

SEQ ID NO: 1732 - DNA, 105 bp; double-stranded, linear
tatgtggtgttcaatgcagtggtcattatggtgcatcttaccagattcggcattcttattataactatacttgtaataaatggcgacatgcagacacgncaatac

SEQ ID NO: 1733 - DNA, 60 bp; double-stranded, linear
tttacgttccatagcaaagtgatacaaacgtcagcatcaatgtaaggcatagatcatagt

SEQ ID NO: 1734 - DNA, 56 bp; double-stranded, linear
ttccatcatacattcgcgttttacttttcttctggtatgatcaaatattcacataa

SEQ ID NO: 1735 - DNA, 57 bp; double-stranded, linear
aaatggggatgaaacagttagtgtacaggtgaaagcttaacagcagctacaattgca

SEQ ID NO: 1736 - DNA, 61 bp; double-stranded, linear
gatttgcaattaaacttaaatgtaatttttcggaatgtgtatttggtttacttaaagtaaa

SEQ ID NO: 1737 - DNA, 57 bp; double-stranded, linear
aaagaagctaaagaaaaagttgataaaacagcaaaagtgattattagctacagcatt

SEQ ID NO: 1738 - DNA, 54 bp; double-stranded, linear
caataatatcgctaaaaccgccatttgtaccaaatgaatttgataatgctgcag

SEQ ID NO: 1739 - DNA, 59 bp; double-stranded, linear
tagagcccaaccggcaacccatccatggaaattcaccaaaataatacattgaccccaag

SEQ ID NO: 1740 - DNA, 136 bp; double-stranded, linear
cctttttggnaatttaagggggttcccaaccaaattcccccaaatttttttgggttaaaaaaacccggcccaaaaatttaagggaatttggaaaaaggtttggttccctttttttcccaaggcccaaaatttggaa

SEQ ID NO: 1741 - DNA, 53 bp; double-stranded, linear
cattcaaccaacgactgacaacagaacatttaagagtctaggacattgattga

SEQ ID NO: 1742 - DNA, 52 bp; double-stranded, linear
gctcgtctgattcagtcacaaaattgtcttgttatacttgtcacctatcatc

SEQ ID NO: 1743 - DNA, 53 bp; double-stranded, linear
tgttatttaaagaggctcaagctttcatagaaaacatgtatagagagtgtcat

SEQ ID NO: 1744 - DNA, 94 bp; double-stranded, linear
tctgagttaaagacgtctcacttaaagctttagcaattccaacaatcagatatcttcacacgtgttatatgtgtccattaatatatcctgtggc

SEQ ID NO: 1745 - DNA, 212 bp; double-stranded, linear
ggaaaaaanntttttaaaaaaagggaaaagggaattggggttcccggcccctttttaaagcccccaaattaaggaaattttaaattttggggaaggggattttccaccggttaataaaccgccgattttgagggggttgaattaattggcccaaatttaaaaacctggatgctgggtccaattttttaccgggaccaattggtcctgcatga

SEQ ID NO: 1746 - DNA, 58 bp; double-stranded, linear
tatcttccgatgaagaacaagatgcacaagaagtacgccaatgatttaagaaagtggt

SEQ ID NO: 1747 - DNA, 105 bp; double-stranded, linear
ttggtttttttaaaaaaatttaaaacccttttttggggccaatcccaattaaaattttaaaaaattaagnccttttttaacctttcccttccccaattggggcct

SEQ ID NO: 1748 - DNA, 52 bp; double-stranded, linear
agtgcctattactttgattgatgtccaagtttcctatcacacaacttaattt

SEQ ID NO: 1749 - DNA, 95 bp; double-stranded, linear
aaagcatcatccgaactccaatgattatactccctagatattattatgtgatgctttgagcattaattagagatgggacgattccatgaaagata

SEQ ID NO: 1750 - DNA, 63 bp; double-stranded, linear
ttgacacatctactcacattaaaagtagatgaagcgttgagattaacatttccacatttacaa

SEQ ID NO: 1751 - DNA, 116 bp; double-stranded, linear
tcgatatttgagacacgctgctgtaataaaacatcctataaagtatataccaagatctaccaatataaacagcggctatatgatataaatgctcagacacacccnctgcgatccat

SEQ ID NO: 1752 - DNA, 114 bp; double-stranded, linear
tatgattaagcttagtgcagatttgatttattnaacaacgcttcactacattaaaaatagggcactcgcacatatagttgtatcaatagcctttatcaattttttgggaaggtt

SEQ ID NO: 1753 - DNA, 52 bp; double-stranded, linear
aacttcaaatgtgccaagtgttgaatcacatcaaaatcatttttatttaacg

SEQ ID NO: 1754 - DNA, 75 bp; double-stranded, linear
actaatcccttgcgtgtttccaatcaattgcattattagtggccatttgtttgatataactgacaagctttaacc

SEQ ID NO: 1755 - DNA, 53 bp; double-stranded, linear
gtgaacaagggtagatgtaaatagttgatgcatgtgtacacatcataacaaaa

SEQ ID NO: 1756 - DNA, 66 bp; double-stranded, linear
ttatttgggcaggcaaatacccttaatatattcaaatcatgttaatatcattgctattgctaaacc

SEQ ID NO: 1757 - DNA, 57 bp; double-stranded, linear
attaatcggagcacttgggttcgcaatttatgctgaaatggatcattctacatcatc

SEQ ID NO: 1758 - DNA, 399 bp; double-stranded, linear
cgaacaataactctaagtatccaacaaatgctgcaagtgtacctactgtgattgatccagaaatagcaagatatgcaccaacaccgatgacaataattggtccaatatctgtaactgtattaattgcggcaaaggaataggcattccatcttgtatgtttcaacgcacgtgttaggaaattagtattctttttatcaaagtttttcgcttcattgtcttcaatcgcaaaacttttaacgactgaaataccttgaacacgttcatgcaagaatccttgaacctcagctaatgcttgagatctttcangtgtcaattttcttaatcttccaaagaaaacgtacaccgttaaaatgtaaaatgggaagataaacagtgctgctaaagtcaatttcacatcta

SEQ ID NO: 1759 - DNA, 139 bp; double-stranded, linear
nattatgtcatgctaggtcacttgcatcatccatttagtatagaagacgacaaaattaaattatagtgggctccttgattggcagtattcattttcgggaagcggggtccaggcttaaagggtattagacgtggttacc

SEQ ID NO: 1760 - DNA, 315 bp; double-stranded, linear
tcgcccctccaggctattatttcatctatatcattgtcatcagttaaattcagcctcgacatttccatttcaatagactgttcattcaattctaagtcattattgtaagtttctagttgattttcataatgatttagattattttgctcaattaactttctttgagacaattgcattaacttatcttcaatctcctttgagagttcttgatgctgattcacatcttgaacatacttcttataatccacctcaaaattagtgatattantatatntcgagagtgtttcaaattcagtgatgagatctcgacataat

SEQ ID NO: 1761 - DNA, 399 bp; double-stranded, linear
taaatcctcgagattcttaatagggtagatatctaacgttttcgcaaagctctttttgatttgttcttcttttgaatctccaatgatcttattatcaccatcacaagatgtaacaaagatgattaaaatcaacaaactaatgcacaatccaatcctttttatagacttcattgttacacaccatcctcatcattcatcatcttcatctaccttcgcggctggaaattcaaagaatctattactgacaaatcgctttttccaccttttgaaaagtcaatttccaactttttataacccacagaacttcctttcaaattaccatcaatatgcatttttaataccggtgctttatcagtaggaatattataacgacttcttaattgcttaacattttcatct

SEQ ID NO: 1762 - DNA, 224 bp; double-stranded, linear
gtatagaagacgacaaaattaaatatagtggctccttattgcagtattcattttcggaagcgggtcaagctaaagggtatagacgtgtacaattaatgatggcattattaacgatgtatttattcctcttaagccacttagacaattggnaattatctcaggcgaatataatgatgttattaatgaaaaagttcatgtgaaaaataaagataattatntacatt

SEQ ID NO: 1763 - DNA, 54 bp; double-stranded, linear
agcaaccaacgccagataaagcagaagataacgcatttccccccatcaccatat

SEQ ID NO: 1764 - DNA, 59 bp; double-stranded, linear
attcccttatcgcattctgtaaaatgatcttcatcagaaattgcttcgatacgtttatg

SEQ ID NO: 1765 - DNA, 54 bp; double-stranded, linear
gattcaattcatctgtatagacgatatatcctgatatgaattggaaatggaata

SEQ ID NO: 1766 - DNA, 85 bp; double-stranded, linear
atcgcatagaagcattagactcaaactattttcggttatgagaataactctgacatccatatggatacttagtttccaagttaga

SEQ ID NO: 1767 - DNA, 54 bp; double-stranded, linear
cagtactgctgaatgatgctattgattttctcatgagacatggcgataacatcg

SEQ ID NO: 1768 - DNA, 116 bp; double-stranded, linear
gncactactaatcgtatcaggatcactaattaaggcatccagcatcagatacgagcgcacgtcagactaatctactgtcatgataaagcagctgctaaccttgtaagttcgtgaaa

SEQ ID NO: 1769 - DNA, 82 bp; double-stranded, linear
gttctatccaatatggaaatgaggacattatgcgtgaaagctatggacgatggacgatggtacacgcatgttgtgtaagcag

SEQ ID NO: 1770 - DNA, 152 bp; double-stranded, linear
tatctgtattgtagtaatccgcttctcccatctatatagggatctttcgtagatattcactttatgcctaggatccaagatgtgtaagcagcactttgcattatctaatgcaaagggnacatgcggctgtaagccctgttctgataatcata

SEQ ID NO: 1771 - DNA, 51 bp; double-stranded, linear
tggaggcgaagtaaatgaaaagtattacgtttgaagaacattatgtcattg

SEQ ID NO: 1772 - DNA, 232 bp; double-stranded, linear
ngaaacaaatatctgatgagatatgcaatgatgactataagtaacattaaaatgaagccctatacattgcgaagattatttaaaagcaaagggtatcaataacgccacgccacatagatgcgtacaccaattatatctttgtggntgttatattaaatctatattatgttcatttaacagcatatgttaaaaattgacagttaacacatgtagctatttgatgtgaatgtgc

SEQ ID NO: 1773 - DNA, 108 bp; double-stranded, linear
taatgtcccccagaatgtaggcaaatgcagaacctggttttagggtcaactgtttnttctccaagcagaaacaaagttcttgtgtcagtgcacttttggtccaccatt

SEQ ID NO: 1774 - DNA, 111 bp; double-stranded, linear
cgcaattgaaggatacactattttaagagctgcaaacatgcgggtgtaacgtgtggtatactgcaactttggtnattggtttagtataagataaaatcatcacaatgaatc

SEQ ID NO: 1775 - DNA, 73 bp; double-stranded, linear
caggttatcagctaatagatatgttgaagaggcagttgcaggccaaatgaaactgcagatgtagttcagtacc

SEQ ID NO: 1776 - DNA, 67 bp; double-stranded, linear
tagacacagtgcaaaatctggtacagcttatggaattagacgggtaaagcaaattactgagtaccca

SEQ ID NO: 1777 - DNA, 127 bp; double-stranded, linear
gtatgccagtgtcattgctgaaaacatcaaccattccctgcaccaaaattttttggtagagtttgatgctggccatcctccaagggactaagggtaattttgnttaaaaagagccaaaggcccaatg

SEQ ID NO: 1778 - DNA, 236 bp; double-stranded, linear
gaacccaaaaattagcaacagtggctacaatagttgggcactgaaagccagccaagtgggatttttagcccttgatttgaaagcggggtccccaggattaaaaaatttaaattagcctaataagcccaaaattcccatttggaaaaggaaacctccttaaattgggttggaaaaaagnttaaaaaaaaaaaggcccagnccttggaattttttggaattggaaaaaggaattaaaa

SEQ ID NO: 1779 - DNA, 50 bp; double-stranded, linear
tatatccattttcaccaattggttgatcaaattgagaaatttgatatgct

SEQ ID NO: 1780 - DNA, 231 bp; double-stranded, linear
gacgactcgcttctattttaaaatccggcgtacttggttatataaatatcataatggttaaaattaaaaagcaatgtcagttcacactattactgacattcttttagttatgtgtatattattcattcacaagcttttggtctataaatcgagtgatttgctttgtttgtatataaccatctgctacatattcatcgttcattgtaattaatggataaaatagttcatcnn

SEQ ID NO: 1781 - DNA, 209 bp; double-stranded, linear
gtctccctgccccacatttaacattgtaattttgtgatgtgaatttgttggaaacgttattaataatgtcagaataattatagtccaaaacgtaaccaatatatatttacgtttagccaataaccaaaatatgtaataaacagaaattataaatactataaatatccaatcattaaacttgggaacagaaaaatgtgattgcttgattc

SEQ ID NO: 1782 - DNA, 54 bp; double-stranded, linear
gttaaacttagttagataaaatgcaaatcacattattgtagatagtctcttttc

SEQ ID NO: 1783 - DNA, 120 bp; double-stranded, linear
tctggaatgtctccttgtctctctatatagctatagtccgtcgcaagcggacgtaatgttcattttcataatgattatagtatgaaagcgctttcttgtatatgtgacatgtgcgtgtng

SEQ ID NO: 1784 - DNA, 57 bp; double-stranded, linear
ctaccatttacataaagaccgtctaattcttcagtttcaatggcattttggagcaat

SEQ ID NO: 1785 - DNA, 54 bp; double-stranded, linear
tcataaccattaccaagtatccaagcagcttttaaacaatatggcataaacatt

SEQ ID NO: 1786 - DNA, 84 bp; double-stranded, linear
ggatgggtgattttagcaggtttggctatgagtaccgtatttgcattaggaccgatttcatttaacaaaatcataattttgggc

SEQ ID NO: 1787 - DNA, 134 bp; double-stranded, linear
ccggtttacccttaaaattattttttggggggttccattaaaccttccaattcccaattaaccccnacccccctgggttttccttaaaaaccaaaaggcccttttttttcccaacccaaccttgggggaattgg

SEQ ID NO: 1788 - DNA, 70 bp; double-stranded, linear
tatatcaactaaaaagcgcatctgcaaccgacggttgaaaatttggacaggagacagataatgtaatata

SEQ ID NO: 1789 - DNA, 50 bp; double-stranded, linear
aatatccaattatacaagcaggtatggcaggaagtacgacaccgaaatta

SEQ ID NO: 1790 - DNA, 50 bp; double-stranded, linear
tgatttactagctgaatccgacatgcttgatgatacactatgtgaattca

SEQ ID NO: 1791 - DNA, 58 bp; double-stranded, linear
ccggacgctttacttccaactttaggtggtcaacacaggtttaaacatggcgatgtca

SEQ ID NO: 1792 - DNA, 58 bp; double-stranded, linear
catcatcctctaatttagtccaaactcctggatgatatccaaatgaagttccaattga

SEQ ID NO: 1793 - DNA, 62 bp; double-stranded, linear
cacaagttttagaaggaaaccaataacaaatgacgagattaattgccacaaacattaacgac

SEQ ID NO: 1794 - DNA, 103 bp; double-stranded, linear
aaggcccggggggtttaaaaaaaaaggtttaaaaaaggntttggccctttaaacccaaagggaaattttaaccccaaaaaaaaaaaacccctttgggaaaggg

SEQ ID NO: 1795 - DNA, 121 bp; double-stranded, linear
tatcgatcgatcatgtcgaatcgatctgtcgatcgatcgtatcgatcgaatcgcgtcgaatcgaatncgtcgaatcgatgctatcgatcgaatgctatctgagtcgaatcacgtcgatctg

SEQ ID NO: 1796 - DNA, 62 bp; double-stranded, linear
aattcatgttaaaatcctcctgatattagatggcccatttttatttttttcgtttccatata

SEQ ID NO: 1797 - DNA, 397 bp; double-stranded, linear
catactcgacaatttagatggtgaatacttatcatttaagtcctttgacacctcatctaaaattctaggacttttaacaatttctttatacgtatttacaagttgaatattactttgaacctcttgcgccataaactgaggattgtcacccttagtttgattcactaaaatttgagtattagcttgatatttaggtgataagacgaaaaatgtaacaatagcgctaataattaaaaataatagcggtaaaataattaaaatcttcaagtttttttgtaatacttctttaatttttgttaattctaatgtactttccattatttacctcccttaaaaattttcattaaaattggtattatatatatagtatttacatattacatatcgtttaaacaat

SEQ ID NO: 1798 - DNA, 66 bp; double-stranded, linear
cgggtaacagcgaatggtgtgtcaccgtatataactttactatttaatatttggcctgttgctttc

SEQ ID NO: 1799 - DNA, 77 bp; double-stranded, linear
gttgctaagtttgtattacaatttaaatgatttttagcttgagtaagtttatttaaagatgcagtaatttcgctagg

SEQ ID NO: 1800 - DNA, 172 bp; double-stranded, linear
taatgctatttaattttctacttcctaagcttccacccataacgagtaanacttttttattttcattaaagcctgttaattgataaccattatgtgcattaccattttttaaatcttctcgaattgttgctccaataaaatcagctttctctttaggtaagtagtttagcgt

SEQ ID NO: 1801 - DNA, 140 bp; double-stranded, linear
caaagttgatatacgctaaaggtactaacacacggtctttgtaatattttaagcgattgtagtaaaatttgtcatcacgatcagcaaaagcttttgattctgacgtatcttccataaatgatctaaaaattggtagttcg

SEQ ID NO: 1802 - DNA, 60 bp; double-stranded, linear
atcccccgtacagacttcagcttacgtaaacatgctgaacactctagtgaagatttcaaa

SEQ ID NO: 1803 - DNA, 60 bp; double-stranded, linear
caatttaaatgcatctttcccattaatttcatttgttgtcgctttagctgtgttaattaa

SEQ ID NO: 1804 - DNA, 50 bp; double-stranded, linear
acttgatcgaaaaggtttcataccggtaaacgataaagttgaaacaaatg

SEQ ID NO: 1805 - DNA, 53 bp; double-stranded, linear
cgcttctttgataaacgttagtgttacttatgcaatagcttgtctattgtatg

SEQ ID NO: 1806 - DNA, 70 bp; double-stranded, linear
aagaactgtctatgaatattggatgacgctttgatgagaacattagtaagccatttgttcaaggagtaca

SEQ ID NO: 1807 - DNA, 77 bp; double-stranded, linear
tagcatttctaatggaatccaatcttaccgaatgacaattggaatataactggtgataatgttgaatggtcctgtga

SEQ ID NO: 1808 - DNA, 121 bp; double-stranded, linear
cccggcccaaaaccccttttttgggtaaaaaattttttttaaaaagggaaaaatttccccttttttggttcccaaattttaaattagaaagggcccccccttcccccccaaatntttccca

SEQ ID NO: 1809 - DNA, 60 bp; double-stranded, linear
aagtttggtgaaggaaccacgtgcatgatggtgttcaaacaatgcgttacgatgttgacg

SEQ ID NO: 1810 - DNA, 58 bp; double-stranded, linear
tggttgagaaaacacagcgttaaagttgaggtatttcaaaagacaagttggaacatta

SEQ ID NO: 1811 - DNA, 55 bp; double-stranded, linear
cttaaatagcaagtggttttataacaactttgagttatctcaatatagttatcgc

SEQ ID NO: 1812 - DNA, 50 bp; double-stranded, linear
taagtcttcaattttttcagttgatacacctaagtgatacagccattctt

SEQ ID NO: 1813 - DNA, 50 bp; double-stranded, linear
ggcttgggtacattaatcgggaccccgccattaattattttanaaggaca

SEQ ID NO: 1814 - DNA, 1002 bp; double-stranded, linear
tggtcatgcgggaaatactaggacatgaaaattatgctaaaggcatcaaagtaactgaaaataatggcgtagtggatatagatatgtacattattgtaagttacggtgtgaaaatatctgaagttgccaataatgtacaatcaacagtgaaatatactttggaaaaatcacttaatgtatcagtaaattcaatcaatatatatgtacaaggtgtacgtgtgaataatacaggcaagaaagcttaggaggacaacttgaaatgattagcaaaattaatggtaaattatttgccgatatgattatacaaggggcacaaaatttatctaacaatgcagatttggtagattctttgaatgtgtatccagtgccagatggtgatacaggaacaaatatgaatcttactatgacttcaggtcgcgaagaagtagagaataatttgtcgaaaaatatcggcgaattaggtaaaacattctcgaaaggtttactaatgggtgcaagaggtaacnctggtgtcatcttgncacaattattcagaggattttgtaaaaatattgaaagtgaatctgaaattaattcaaaattgttagctgaaagtttncaagctggtgttgaaacggcatataaagctgttatgaaaccagttgaaggtacaatacttacagttgcaaaagatgctgcgcaagctgcaatagaaaaagcaaataatactgaagattgtatagaattaatggagtacattattgtaaaagccaatgaatcacttgaaaacacaccaaacttattagctgtacttaaagaagttggtgttgttgatagtggcggtaaaggtttgttatgcgtttacgaaggattcttanaagcgcttaaaggtganaaagttgaagccaaagttgcaaagatagataaagatgaatttgtacatgatgaacatgatttccatggtgtaattaatactgaagatattaatttatggctatngtactgagatgatggttcgttttg

SEQ ID NO: 1815 - DNA, 351 bp; double-stranded, linear
taataaaaacttactttaatacacgctttaaagattattaaatcagcgttttaatttttagacaacgctattatttttagtttttcaattctattatgtcataattatgtcactcaaaaactgttttccaacattgatttattgttggaaaatctcgaaaatctagtctatttctccaacaatcgaagarttatgcccttttttctccctttaaataagtcataatacgaggcatacatgcaacatttacaataaaatatgttcctacatcgtattatacgaatgctcacacttatagttgtttagtaaacccagatgtattgctaacatacccatnancnctatatagtt

SEQ ID NO: 1816 - DNA, 62 bp; double-stranded, linear
atatcgtatcccatgcgggaagggctttatttatactgtgcacgatgaatgcgcacaacggg

SEQ ID NO: 1817 - DNA, 70 bp; double-stranded, linear
aaaggggggaaattttttttttttgggtttggggggaaaattttttttgggtttgggaaatttaaattaa

SEQ ID NO: 1818 - DNA, 51 bp; double-stranded, linear
caagttcggaatgcgaacgcgtcttaatctatatacaagtgatgcactcca

SEQ ID NO: 1819 - DNA, 52 bp; double-stranded, linear
tcgccatactatcgacagctgctaaaattgcgctcttcttgtgtcgcaatcg

SEQ ID NO: 1820 - DNA, 58 bp; double-stranded, linear
caaattggggaaattactagaaatgaagatatttataaagatgactggacgtcaactt

SEQ ID NO: 1821 - DNA, 58 bp; double-stranded, linear
actgcttcagcacctgtattcattggggaaagctttatcgttgaccggccagtttaca

SEQ ID NO: 1822 - DNA, 190 bp; double-stranded, linear
acctgttgctcgtgtcataaataggtgactataaatctctgttcaatatacttttcgtttttccaatcttaaaggtcgatgttcgtgagtaatcttatctctggnccaattttaatgtcatgatatgttcatagtatcacccctttgttgtgtaataataatcaggtgggtggttagaacggtgtgaata

SEQ ID NO: 1823 - DNA, 50 bp; double-stranded, linear
agcnttagcntatggtttagacacaactgntaaagatgcnaagttcttgt

SEQ ID NO: 1824 - DNA, 102 bp; double-stranded, linear
aaaaattggaaaaaaggggcccaaaggttaacccaaattggaaanaaacccaaattttttggaaattaacccaaaaattggcccccaattggaacccaaaat

SEQ ID NO: 1825 - DNA, 57 bp; double-stranded, linear
acgtaccaatgtcataatcagtcattttaccactcttaataatctgcttccgggcaa

SEQ ID NO: 1826 - DNA, 61 bp; double-stranded, linear
accatcttgtacaaagtggatgtcatatgcaccatcttgtgttttgagctgcatttaattg

SEQ ID NO: 1827 - DNA, 56 bp; double-stranded, linear
accgtttcgccaagccgacctaatttctcagcaatatttctttctacgccaccaat

SEQ ID NO: 1828 - DNA, 62 bp; double-stranded, linear
acttatagggcgcacttatttttcgcttccatagcgaaactagtgtcacttatacgtatgtg

SEQ ID NO: 1829 - DNA, 54 bp; double-stranded, linear
gctacacacgatttacctttcttgtcacgttttgcgaccatcattgtgatgata

SEQ ID NO: 1830 - DNA, 67 bp; double-stranded, linear
gtaatgaccatcgctgatttatgacattgttagatctcatgtgccatttagtctgctgaatcttggg

SEQ ID NO: 1831 - DNA, 50 bp; double-stranded, linear
ataactcttcgncaaactcctcaacaaacttcttgtgttccatcttctgg

SEQ ID NO: 1832 - DNA, 101 bp; double-stranded, linear
aaacgtnagaatatttaatggagccaagaatggtttacagacggagaaatgggatatgttgaagcgaggcgtacgcggaaagcgtactaggctagaacact

SEQ ID NO: 1833 - DNA, 50 bp; double-stranded, linear
tcgtcatcatgtctgtgttaccaacgtttgacgatttanttcatgcngaa

SEQ ID NO: 1834 - DNA, 55 bp; double-stranded, linear
ataagttaattgatttattgataaagagaagccagatttaaatattattaaacgt

SEQ ID NO: 1835 - DNA, 58 bp; double-stranded, linear
aaacaagaacccccatatggttaagctgcgcgtttcaacatacggggggttttcatat

SEQ ID NO: 1836 - DNA, 125 bp; double-stranded, linear
tacgttttataaaaacaagaactaaagtatgcagtgtgaattgttcactttcntggcgttggaattgattaaaacgagatatggtgttgtggaagttgtttgtgtttgcatattttaaaccgatt

SEQ ID NO: 1837 - DNA, 118 bp; double-stranded, linear
aatctacaatcctgaatcactcgttaagattaaaagtatcgacaatgagtatctgaacatgagctcatctgccgtttttaatgcnaaaaaccggcggcgggatatttttgaccacggc

SEQ ID NO: 1838 - DNA, 141 bp; double-stranded, linear
atttggggttttgggacccttacccaaaaattggggtttggttattaaaaaaaagccattgggaaccaaaaaaagttnattattggattggctggggcttggcggccaggaaatttaaatgtcccagtttttgggattgcc

SEQ ID NO: 1839 - DNA, 54 bp; double-stranded, linear
tctggggactaagtatgtctcaggctttatgctgttatgtttgaaaatgaaagg

SEQ ID NO: 1840 - DNA, 133 bp; double-stranded, linear
attaaaaaacctttttaaaccgggaacccaaggaaaaattccgggttttaattaaaaccttttgttaattggttccaaaccaaccttttgggttaattttaaccaggaattttggaaaacngttttatttgga

SEQ ID NO: 1841 - DNA, 50 bp; double-stranded, linear
aaagtatggattgatcgtggagaagttcttcctactaagaacactagtcg

SEQ ID NO: 1842 - DNA, 60 bp; double-stranded, linear
gcgttttcctgggatatgtttgatgaatggatgttgtaacatgttaataaatcgttggta

SEQ ID NO: 1843 - DNA, 60 bp; double-stranded, linear
ctgagatgaatattgtgtttcgccatacatactgggtaatatcccaaccattgctgtaaa

SEQ ID NO: 1844 - DNA, 125 bp; double-stranded, linear
cattacctgtaaaaggaagctaaagacgatgagtatttatagaaaccaattgccgaccatttgcagccattaggagggtaggagggcaatcgcgnccaaaggttattaaccgtcaattaccttga

SEQ ID NO: 1845 - DNA, 126 bp; double-stranded, linear
atccacctgggtttgttcttaatttaacctgntaattaattgggttgggtccggcaaaagtccggacctgcaaatcggattttatcgttaaatcttgaattctattgcccatattaaatcgcaaat

SEQ ID NO: 1846 - DNA, 57 bp; double-stranded, linear
ttttgggaataaaccaattaatcatgggcaaaaaataagcaatccaagtacttacta

SEQ ID NO: 1847 - DNA, 50 bp; double-stranded, linear
tgataaatatttcatctaaagagagggagtcattatgacactacttactg

SEQ ID NO: 1848 - DNA, 65 bp; double-stranded, linear
atctaggcaatgaatggacggacttaatattgatgtgcaacaagaagaggagaagcgaatcaata

SEQ ID NO: 1849 - DNA, 244 bp; double-stranded, linear
cgtgtgaagtcattacttttaatcccatgatgatggtgatggatgagacgatatctctctgtctttaacagttaagtccaattcttccaacgaaacttttccataggttgttttataagttggaatacttgcacaaatcatacctaattgcttatcaattttctcaagactgtcatcagttataagatcaattttattaataataatcatgtcacttagtttcaactgatcttccatcaggcga

SEQ ID NO: 1850 - DNA, 106 bp; double-stranded, linear
tttaaaggttcccggaaaggtttgaaaccaaacctttgccccggccccccgggaaaaaaaaaanttggtttaacccccgggggggggggcccttaaaaaaacccaa

SEQ ID NO: 1851 - DNA, 84 bp; double-stranded, linear
ttttttaaggcccttggggggccaattttcccccccccccaaccttccaaaggttggggggcctttttttttaaattgggggga

SEQ ID NO: 1852 - DNA, 52 bp; double-stranded, linear
tcatgattaaaattcaacaattacaacatcactttggatcacataagagtaa

SEQ ID NO: 1853 - DNA, 56 bp; double-stranded, linear
ataaaacatttcaagatgcgcttgtaattgtatgtgatactgccaatgctccacga

SEQ ID NO: 1854 - DNA, 54 bp; double-stranded, linear
aaaagatcatgcgcataatgacatggtgatgatatgagtatgatggtgggtaca

SEQ ID NO: 1855 - DNA, 52 bp; double-stranded, linear
acaacaaatggtaatgcataaacatacagccaatagctacaattgcacgacg

SEQ ID NO: 1856 - DNA, 57 bp; double-stranded, linear
acggctgcactcatcatggtctgtggcgtgattgttaatgttttagttgcccgcttc

SEQ ID NO: 1857 - DNA, 192 bp; double-stranded, linear
gcagataacttccttgatcctaacaaagcaagttctctattatcttcagggttttcaccagacttcgctacagttattactatggatagaaaagcatccaaacaacaaacaaatatagatgtaatanacgaacgagttcgtgatgactaccaattgcactggacttcaacaaattggaaaggtaccaatact

SEQ ID NO: 1858 - DNA, 77 bp; double-stranded, linear
cgctgcacttcctgaacgcagtgagaccagaacgtggtgtcactttcggtctattccggttaagtgttggtctcgga

SEQ ID NO: 1859 - DNA, 53 bp; double-stranded, linear
tttggcgttcgtgattttctctagacgtagtaactttcccactctttgcgtcc

SEQ ID NO: 1860 - DNA, 59 bp; double-stranded, linear
tttctcactcgcgcatttcagtttgttttgatttacccgtctcttctatttgtcttaat

SEQ ID NO: 1861 - DNA, 69 bp; double-stranded, linear
aatgaatgtatgcacattaacatcatcaattaatccttttaataaattgagttgtaatttaataacttt

SEQ ID NO: 1862 - DNA, 54 bp; double-stranded, linear
attaatactgagcaaatgtgcataagacatcatgaattagcaccaatttacagg

SEQ ID NO: 1863 - DNA, 89 bp; double-stranded, linear
tttaaccatcattctatgtcaaagttttgaaatgatggttattttttattgcttaaatttattattgctactactataccaatgaaagt

SEQ ID NO: 1864 - DNA, 400 bp; double-stranded, linear
aaagctggtacgcctgcaggtaccggtccggaattcccgggtcgacccacgcgtccggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgtactaacttccatggcatggatcttacccgtgacaaaatgtgttccatggtcaaaaaatggcagacaatgattgaagctcacgttgatgtcaagactaccgatggttacttgcttcgtctgttctgtgttggttttactgaaaaaacggcaacaatccagatacgggangacctcttntgctgcagcaccaacaggtnccgccaaatccgga

SEQ ID NO: 1865 - DNA, 51 bp; double-stranded, linear
aaatggcgtatctttatgtatcaactaagtaatcaccaatttctttcggat

SEQ ID NO: 1866 - DNA, 58 bp; double-stranded, linear
gtgttgcggataatccgtcgacattagcgtctgaaggtatcatgaggcaactgcgcaa

SEQ ID NO: 1867 - DNA, 60 bp; double-stranded, linear
acagcaactgacccagtttactaccgtcactcaaatcacacaggtggtatcaaatcaatc

SEQ ID NO: 1868 - DNA, 56 bp; double-stranded, linear
caatctcttaccatttatctcagctggtgaaaacggtccattacacttagaataaa

SEQ ID NO: 1869 - DNA, 65 bp; double-stranded, linear
gctatagactagaggtacagcaaattcatgtgtacagtgattagaaggcgatgagcaaaagtaat

SEQ ID NO: 1870 - DNA, 173 bp; double-stranded, linear
gctactggcgggggatagtaacacccaatgttacacgtatatacgtacggcttcttgataaaaagatgaagccnttacaagtagagagcgtaagaacgtgatcatctaaatggtaagggtagactatcccatgccattgtgggcggttgcataggtaccacggcacatagcgg

SEQ ID NO: 1871 - DNA, 104 bp; double-stranded, linear
gctgtgggattgtcctttggcatggggttagggagagcgtttctaaggggcgtttgaaagccattgatccgtaaaaggaccattgttggaagcngccttaagaa

SEQ ID NO: 1872 - DNA, 64 bp; double-stranded, linear
ccattatctcaagaggttctagtaaggggatggcatttgcttcttatgaatttgaccagaataa

SEQ ID NO: 1873 - DNA, 377 bp; double-stranded, linear
gacaacctattgtttccctaccatactgttgtccggtttgacaaaacggcgttccacaatccatacatcgtgcaccttggatagaggcatcttctttagtaaatcgttgttgatatgctttatgatgcttcaaacggtctaccagtgataattcacctaagtactgtttgtcatacttcataaatcctttaaattcacccatcgtatctccccctttccttaatacacaacggctggtttatgtttagcatcgattgttttgactgtncatcgtaaaatgcagctaacatcgcttcatcttccattgtcatgtgaagattttgtggcaaanggaattttttgcatcaatgaatnggtgaacctttgggggtgacctt

SEQ ID NO: 1874 - DNA, 78 bp; double-stranded, linear
attatctgaatacgcagcagttgcagcacttgatggatcagcagtatttaaaagaggttaacacattacccaatagtg

SEQ ID NO: 1875 - DNA, 256 bp; double-stranded, linear
ctaaaagaagttaaagagtgtgatggtagaattatattatttattgatgaaatgccatatgcttgtaggtgstggtaaaacagatggtgccatggatgcaggcaacatgctaaaaccaatgttagcacgaggagagttacattgtattggtgcaacaactttaaatgaatatcgagaatatattgaaaaagatncggcattagagcgncgtttccaaaaagtagcagttagtgagcctgatgttgaagatacaatt

SEQ ID NO: 1876 - DNA, 286 bp; double-stranded, linear
agcgcgaaattgagcaagcggaacatgcgactgatgaagaaaaacaagttgctttaaatcaattagcgaataatgaaaaacgtgcattacaaaacatcgatcaagcaatagcanataatgatgtnaacgtgttgaaacaaatggcattgctacactaaaaggtgtacaacctcatattgtaattaagcctgaagcacaacaagcaataaaagcaagtgcagaaaatcaagtagaatcaataaaagatacaccacatgcaacagttgatgaattagatgaagcgaat

SEQ ID NO: 1877 - DNA, 74 bp; double-stranded, linear
acttccaaacatgataaagacagactacttcacaggtttaagggaagcaaccacattagcgggattcaccctat

SEQ ID NO: 1878 - DNA, 52 bp; double-stranded, linear
tttcattaagttcaaaaaatctcaataactttaaggattggtccgcatatta

SEQ ID NO: 1879 - DNA, 60 bp; double-stranded, linear
atacccctgagattaattacttgtcctttttttagaacaacatctcctggctttgtttcg

SEQ ID NO: 1880 - DNA, 60 bp; double-stranded, linear
aatatcattaataatatcattgatgcaagtcctattgtgcacaactggggtgattgcctt

SEQ ID NO: 1881 - DNA, 56 bp; double-stranded, linear
acaatggcacatggacttatgcctggggtgtcctgttcgtcgcagcatcaaaatga

SEQ ID NO: 1882 - DNA, 121 bp; double-stranded, linear
tgcaaagcattggcacatggccagtcagttttacaacgtcgtgactgggaaaacccgagangcgacgttgtaaaacgacggccagtgccaagcttgcatgcctgcagtcgactctagagga

SEQ ID NO: 1883 - DNA, 56 bp; double-stranded, linear
acatttaatgtataaccagtttcaacattgccgatttagtggcagcagttgcagga

SEQ ID NO: 1884 - DNA, 52 bp; double-stranded, linear
tgcatccatttgattgaattttatgttttgaccaaagccggttgcaatgtac

SEQ ID NO: 1885 - DNA, 51 bp; double-stranded, linear
tgaaaagtggtggaatggtgttaaaagttggtgggtaattttagagaagag

SEQ ID NO: 1886 - DNA, 95 bp; double-stranded, linear
tacacgaaccatactcaccaggttttcgtgtcatgaggcgatattttttgtcattttatatacatttatccaaattcatcttttaaatgttgagt

SEQ ID NO: 1887 - DNA, 65 bp; double-stranded, linear
gctaccaaaggcgttttacctattgctagtcactgcaagtggcttagctatgcagatcaactggt

SEQ ID NO: 1888 - DNA, 60 bp; double-stranded, linear
gtgggaccaactggccggtgacggtggtaaaggtgcttcagtcgtattgaagtgggatga

SEQ ID NO: 1889 - DNA, 57 bp; double-stranded, linear
tgttggagaaacagttaacgaggtttaatgttaaaaaagcaacgtatcatgggtata

SEQ ID NO: 1890 - DNA, 64 bp; double-stranded, linear
tgggatctgcttgcaaatacacaaaactttctggattttattacaattgcaatataatcaaaca

SEQ ID NO: 1891 - DNA, 59 bp; double-stranded, linear
ggcatccactcagataaaataaagatgtcaaaaaggcaaagatggtgctaaaaaaacaa

SEQ ID NO: 1892 - DNA, 54 bp; double-stranded, linear
ggtatctcaacgatcctttaggttaattcggaaatttctacacgtgagttagca

SEQ ID NO: 1893 - DNA, 52 bp; double-stranded, linear
ttgtcttggcaatggcagagcaacagaagtttaaagtgcttgctgatcatat

SEQ ID NO: 1894 - DNA, 79 bp; double-stranded, linear
taaacctataccctgtaaaaagaaaaatcgtggatcgaaagaacatgtatgtggcatttatgattgatgctcaagcaga

SEQ ID NO: 1895 - DNA, 377 bp; double-stranded, linear
ttataaaggagagaaatccttaattatgaataaagcatcatttgataaaaaagttaaaaagcaattatggtttttgaacaagaaggagaaacaagcattagatcaacgattgtcttctatatctgatgatgacagcgttaacttaaataagcctgttacctttgctaatgcttacttaagacaaaatgtatttcgaaataaagaaacaaaaagttatagtatgtttgttacattagtagtgatgatgtttgcttatgttgctttattaggtttgtntttatttgggctaattacaagtctatctggcgtacaatttttcgttagtcctaaggtagatttatctacnactgttgttattttaacaatnattggagcga

SEQ ID NO: 1896 - DNA, 58 bp; double-stranded, linear
ttaggatccgtctttgccgcagcgtgggtgttccgcgagcgcttcttagaggttttgc

SEQ ID NO: 1897 - DNA, 445 bp; double-stranded, linear
atcgctcaaaccgaaattgaaaatgcatctattacttcattaagccgtttaccagacgttatattagcattgaaaagtggaaaggttgaaggtgctgtagttgaaaaacctgtagcagaagcatatttaaaacaaaatcctaaattaggaatttccaatgtgaaatttaatgaagaagaaaaagatacagtgatagcagtgccaaaagattcaccaaaattattgtcacaaattaataaaacgattaaggaggttaaagataaaggattaatcgataaatatatgactaatgctgcaaatgcgatgaatgatgacagtggttttatttctaagtatggtagttttttcttgaaaggaattaagattacaatattaatttcacttatcggtgttgcattaggttctattttaggtgcattcgttgcgttaatgaaattaagtaaaa

SEQ ID NO: 1898 - DNA, 101 bp; double-stranded, linear
accttttcaatgttgctttgatataaattcacaaagttgacttttnaattcttcaatagattctctactgcgatagctgaattgccatcttttctactact

SEQ ID NO: 1899 - DNA, 75 bp; double-stranded, linear
tgccctggatgcctttaacttgattcatgacctgtggttttatttcaatttagatgagctaccttcaagaccttc

SEQ ID NO: 1900 - DNA, 54 bp; double-stranded, linear
agcaatacggaactgatgaacggaattgtaatacgagaatatgaagcatcaacg

SEQ ID NO: 1901 - DNA, 60 bp; double-stranded, linear
agtacctgagtatcgcagaccggcttcaggtcgtagaatttctatacgtggagctagaag

SEQ ID NO: 1902 - DNA, 51 bp; double-stranded, linear
gtctaactacagcatgccggcttattgttgcactttctcaatatttccata

SEQ ID NO: 1903 - DNA, 50 bp; double-stranded, linear
ggattnaaacgtgcattaacgcgtgtnttaaatagttatggtttaagtag

SEQ ID NO: 1904 - DNA, 53 bp; double-stranded, linear
atcgtatttatttcagcgagtagcggtagccttcaatacacaaagattttacc

SEQ ID NO: 1905 - DNA, 50 bp; double-stranded, linear
ataagacgctagatctggtcaatttatttccgattttttcaacactattc

SEQ ID NO: 1906 - DNA, 51 bp; double-stranded, linear
ttcatctgaatcgtcggctttcgcgattacttcttcgtcagggttgctatc

SEQ ID NO: 1907 - DNA, 55 bp; double-stranded, linear
caattgctaataatccttttaagtcattaatgatttgatcttccgtaatgttgaa

SEQ ID NO: 1908 - DNA, 53 bp; double-stranded, linear
ttgccaaacagacatgacttaaatttcaatatcttctttgactgcatcgatat

SEQ ID NO: 1909 - DNA, 94 bp; double-stranded, linear
tgaatttctatacaattatggggaagggtattggtgaattggaatgggctcctaagtttacaagcccccattcgatggccgttaaagtttttaa

SEQ ID NO: 1910 - DNA, 66 bp; double-stranded, linear
aacatgatcgtggggggatgttatgtttgttcatatatttaggaagtcgtttgtagttattgtttg

SEQ ID NO: 1911 - DNA, 55 bp; double-stranded, linear
atcttcgctccacttactgcaataaggatttgcggcaatcctaaaccgtttttca

SEQ ID NO: 1912 - DNA, 59 bp; double-stranded, linear
aacaatcgtaacgatacaacgcaatcttcgaaaaataatgcaagtgcagatttccgaaa

SEQ ID NO: 1913 - DNA, 51 bp; double-stranded, linear
acaccacacacacacacacaacaccccacacaacacacacaaacacacaaa

SEQ ID NO: 1914 - DNA, 111 bp; double-stranded, linear
tgttacgacttggtcgacctggcaagcgcttcgcgcacgttctgcagcntctcacttattggtatcgcgatgcgacgttaagaaatttcggagttctggtcaccttatgtt

SEQ ID NO: 1915 - DNA, 56 bp; double-stranded, linear
tggtccgctctcaatcgcatcttcaggttttacttggcaaaagagcgcggtgctca

SEQ ID NO: 1916 - DNA, 62 bp; double-stranded, linear
gccgacagtaaaataaaggtacttgatataacatataacggaaagcaacagttactgtcaca

SEQ ID NO: 1917 - DNA, 103 bp; double-stranded, linear
atgatatttatttgattgaagagatgttgcttaaacaagaagacgtacaattgatanaacgtaaagattatattcagcaccctaaagaaaatggttaccgcag

SEQ ID NO: 1918 - DNA, 60 bp; double-stranded, linear
cagtgtagcgtgtgtcatgccgttttaccacaattgaagactgagctctatccctgtgcc

SEQ ID NO: 1919 - DNA, 117 bp; double-stranded, linear
tcaaattaacttccaacaaaaacaaatgcaaggtgaagaaattgctgaagaagatttacaaaaagcgcaagaacaagcgcaagcaattgaaaaagatgaaaacatctctncattaat

SEQ ID NO: 1920 - DNA, 400 bp; double-stranded, linear
tgcctaatgaaacatttaaaaatatttttaaatatatctatcaacacatcgttctattaattgggattgttagttttctcaaaggatttttaggatttttcatggaaaaaaatggaagtaatttatattttgtttcattcccgttttcagtagtcgttggattctttattgtctttttatttatatggtttagttttaaaacaatacaactgcagtgttttaacaattcaaattggatatggatattcacctatttagcaatcattctactaattgtaggatttttctatgtattctttattccacaatcattacttgcctttggaccatatattcaggtaagcaattgggtatttattatattttcatttatagttatgcctatnggattacgcattga

SEQ ID NO: 1921 - DNA, 122 bp; double-stranded, linear
tcacagtcatcatttnattttcgattttcaataattgtatttttaatttatcttgatattcattaagatttatacaagctatctttaacattgccttatctttgatatatttcttgcattcg

SEQ ID NO: 1922 - DNA, 410 bp; double-stranded, linear
agaagataccatacacatttaattagttacagcataaatcaatttatacccttaattattacattgtttatattttaaattcgggggagtaattttaagtaatatcttgttgctgctaattctattgttaataaattgatattagatgtagaaattgagtgtgaaagttaataatagatgatttagctagtaacataattaattcatatatagtcaaaaagttctgttagatactgttcttgatgaatattctttgatgttaggtgttagctattctagatgagtttcttagatgtggatgcctgtcttgatgaagttatctatgatgttaatataatacttgatgttgattcttagatgttagtgcgatttcaagatgctgattctttgttgttgcactatcttggtga

SEQ ID NO: 1923 - DNA, 348 bp; double-stranded, linear
tttctatggtttatcaggtgattttacggaaaacagtgaagattatggcgtataccgctttaaacgtggatttaatgtacaaatcgaagaattaataggggatttctataaaccaattcataaagtgaaatattggttgttcacaacattggataaattacgtaaaaaattaaagaaatagatgtaaatgatgttagggcttatagtnattgatactataggctcttttttatatgttttttaataaagcctcgaataatgatatattaaatgacaagtttaacaagtgattgcaataaatataaatntgaattgcacaaccgatttgnaaatgattgagttgaggaa

SEQ ID NO: 1924 - DNA, 253 bp; double-stranded, linear
agggcagatttaagctaacttggaatgttttcgagtttttgagttagttctctatccattttttcagttacatgagtatatatgcgaatggttgnttgttcatctacatgtcctacccttttcataattgcttttaaagaaacattcatttctactaataaagttatgtgtgtatgtctaaatgtgtgcgtggtaactttcttattcatatttaaagcttttgtacgttttcttaacgcacaccggccatttc

SEQ ID NO: 1925 - DNA, 52 bp; double-stranded, linear
ggtataggtgcaagtcctatcttccgctccatggtttaatgataatgcggga

SEQ ID NO: 1926 - DNA, 84 bp; double-stranded, linear
tggtcactgttcctgatgcttacgttagaatgtaagattcccgatttatcagttatatactgtttgcttcactttggagatctg

SEQ ID NO: 1927 - DNA, 56 bp; double-stranded, linear
ctttctaaataattctagtatagtttttattcaaatacgctaggctcagagctatt

SEQ ID NO: 1928 - DNA, 138 bp; double-stranded, linear
gcaaattgtcattagacggagtattatttagaattttcggtgatatccaccggcacaagatcgatgttggacaatatctaatatactgatacgcatttaaatagaagaagggaattagagtttggttntgaatgcaaa

SEQ ID NO: 1929 - DNA, 52 bp; double-stranded, linear
acatctttatatgcttcaacatcaaatacaccacatattggtaaacaacaaa

SEQ ID NO: 1930 - DNA, 51 bp; double-stranded, linear
tttaatgttcacaacaccggaataataataactaaagcgccgctaataaat

SEQ ID NO: 1931 - DNA, 400 bp; double-stranded, linear
acgaaaaataaataatcatttcacctttatagccagtatttttaattaatatattttcatctattagcgcttctaaaaatctatttgacttttgaacatactctttagctatattattaacaacagtataggattcctcataatttagttgattaaattctgagtcgttcattaattcaactaatccttttattactttttgtacaacattaatatttttatcaaaatcaaatttatcttccttagataaattaatannnaaagtcttaagaacatttgtaaatagctctgcaacacttatagtttggncaaattccttaaatttatttacacagtactcacacattagttttaaaaataatggattgttgaattctggatttaatataggtaacttagg

SEQ ID NO: 1932 - DNA, 100 bp; double-stranded, linear
acttgcggaangacgcaacgtttatgtacgttggaagaaaaattcaggacttacgttcaaaactaccatagcaatatgcattgaaagatgacagtatgcg

SEQ ID NO: 1933 - DNA, 61 bp; double-stranded, linear
cgctctgctttaagcgttgggactttgtcaacggtagtggatgggaagtggttctgctttg

SEQ ID NO: 1934 - DNA, 53 bp; double-stranded, linear
atgttttcatcttgaacaataacgacgataattcctaaaataaaagcgacata

SEQ ID NO: 1935 - DNA, 56 bp; double-stranded, linear
atgtattacggtttaattaagccacataccaacaagattgcatttatggtatctca

SEQ ID NO: 1936 - DNA, 61 bp; double-stranded, linear
tcgcaccagaaacaagggattgttaaaattgcgtaaatccttaaatttatttgtaaatata

SEQ ID NO: 1937 - DNA, 51 bp; double-stranded, linear
atgaataatcatatttctaatcaaagtaatagcatttatattgtgtttaaa

SEQ ID NO: 1938 - DNA, 56 bp; double-stranded, linear
ttgctgaagatagaggcttcatgaaggtggagaagttagctgatttctggaacagg

SEQ ID NO: 1939 - DNA, 51 bp; double-stranded, linear
atctcaatgtattcctctagtgtaagttcttcataaataaccggtgattcc

SEQ ID NO: 1940 - DNA, 318 bp; double-stranded, linear
ctcaggtcgactctagaggatcccctgttaaataaaacttcttaagcacatacttatttcactatgccttttacgttccccttatacttttctcacatctttctcttagactactcccttatacgccccgctcaatatctttaatcatttcatctacagttattttcgcactcgttaagacaataggaacgcctggcacctggatgcgtacttgcacctgcaaaatatawatctttataatctcgcgatacattytgtggacgataataattactttgcgctaaagttgggcattaaaccgaatgccgaaccaaattc

SEQ ID NO: 1941 - DNA, 57 bp; double-stranded, linear
ccgggaaaatttttggaattaagtggaaaaaaaatccccttaaaattcccctggcca

SEQ ID NO: 1942 - DNA, 378 bp; double-stranded, linear
tgttcttcttttgaatctgttttattcgtttgttcctcttttttctgttcatctttcatatttccacatcccccaataaaaatgattaaaagtaatacactcatgtacaaagcaattttttttatatactccatcatttcacatctctctgttttaattttataaacatttgaatatttcatacaacttattaaaatagtgattattcaacttttatgttatcaaacaaaactaacttattcaatttaatacatgtaattcattttaactttattattaaatgttctaacgtnattttttatattagtaattatatttatttatcctcgcttggattaaagtagatactatctgtgaagtanatattttctgccttgn

SEQ ID NO: 1943 - DNA, 394 bp; double-stranded, linear
aagaagaagtcaaaattcagctaagtaaaagctcgagttataaaaaagtctaaattgattcaacaggagtagaaaaggaaattagtcttgcatattttagaaaatgaataaaaacagttactatatgcaactcaagaattaaatattatttaagccacatacctattagagtacaaaatatacaagttgtacttatatctaggtatgtgacttttgattttaagcgtaaagtaaaagtttttatgtttgtattagttctaaattattttgcacttggatgacacgtatttttgagtttaagtggtgactcaagttcaataaaataaatatcagataggataatttganaatnatatgaaagggttatctccaaaatnatctccatattataagg

SEQ ID NO: 1944 - DNA, 52 bp; double-stranded, linear
tattcgtgatgacgattgtcggtgacatgaagttctatttgctggcactgat

SEQ ID NO: 1945 - DNA, 82 bp; double-stranded, linear
cgtttaaaaaatgatatcaatctttattgtggattgcaacatccgtgtgctccataaaacgtgtggcgagacttgggaaagg

SEQ ID NO: 1946 - DNA, 70 bp; double-stranded, linear
gtattattgatgaagaaacagctctccagttgtagatgcatgctacgttcacgttaccactgtatcaatt

SEQ ID NO: 1947 - DNA, 50 bp; double-stranded, linear
tatcaccagcaccaaggntaatgacatgctgatcttttgcagttatggtn

SEQ ID NO: 1948 - DNA, 117 bp; double-stranded, linear
attgtatgaatctttggggaatgaactttnaacgaacggacatcttgcaatgacgcatcaaaatggttttaacacatgtaatcggctctcggtactattcgtgtgatgtacacatgg

SEQ ID NO: 1949 - DNA, 64 bp; double-stranded, linear
tttgatgatttcgggatggattggtattgtggtgaatgaattttttagctcatcatcaaattag

SEQ ID NO: 1950 - DNA, 57 bp; double-stranded, linear
ctctagtggccattcatatttgtcgctgaatgatgttggtacatccattgctgctgt

SEQ ID NO: 1951 - DNA, 68 bp; double-stranded, linear
ctgtccttctgaaacttgggtatttaattaggaatagttaaaaaaatcattcacagaaacatttaata

SEQ ID NO: 1952 - DNA, 106 bp; double-stranded, linear
ttaaattaaccttaaggttggnatttttaacccccaaatttttggggtggttaaaattcccccttggtttttggaattttccatttggttaatttcccaacccttg

SEQ ID NO: 1953 - DNA, 50 bp; double-stranded, linear
gacatttacacctgcttcaatctggtccagtgcagcatctaattcttcga

SEQ ID NO: 1954 - DNA, 107 bp; double-stranded, linear
atttggccaactgttcagcacggtattggttcaatgcaacactttatcattgcttcagggctatatcggtggtatgggntgtatcacttcttagaacgtggtattaa

SEQ ID NO: 1955 - DNA, 54 bp; double-stranded, linear
gaagtgaatatgaagctgctaaagactccggaatgctacctcagacaactgatg

SEQ ID NO: 1956 - DNA, 365 bp; double-stranded, linear
atgattattttagttccatttgttgagtcgactgctaaagttccatttaaatgttgtacacgctgtgaaatacttttcacctcacaatcactatcgatacctttgccatcatcttcaatcataagcagtaatttatgattgtttacagtttttaatttaccatgaacttttgaagcatttgcatgtttaataacattatttatcgcttcacgcgtaatcataactaacatagattgtttagtaggacttaatacttgcgctaattctttattttcaaatgtaaaatcaatatcagcatcnntnaaaactttacgtatactatcaatctcttcaataaatgatggtaattttacatcatcaataat

SEQ ID NO: 1957 - DNA, 346 bp; double-stranded, linear
aaataatgtcacaaaagttaaagatactaatatttttccatatactggtgtagttgcttttaaaagtgcaactggatttgtagttggaaagaatactattttaacaaataaacatgtgtcgaaaaattacaaagtgggcgatcgtattactgcacatccaaatagtgataaaggtaatggtggtatttattcgattaaaaagattattaattatccaggtaaagaagatgtatcagtcattcaagttgaagagcgtgcaatagaacgtggaccaaaaggctttaattttaatgataatgtaacgccattcaaatatgcggcaggggctaaagctggtgagcgaatt

SEQ ID NO: 1958 - DNA, 390 bp; double-stranded, linear
ttttccagttaatttttccagttcactaaatactttattgactgtaccagacccaataataatttggtattgtcccccagtagaaaacgtccctttaactacatccatattgtttagcgcctcttcatttactaaactttcatcatttaaaactaatcgtagtctcgttgcacaatgcgccattgcatctaaattctcttctccgcctatcgcgttcaaaatttcttctgcggattgcttataattcatatatttagcctcctaattagaaccggttccatttattccactttattgtaaccggttccaaaaatatttgcaacactctattatcattttatataaacacctacaccatttttgatagcgcattcatttttattgctatac

SEQ ID NO: 1959 - DNA, 50 bp; double-stranded, linear
gattgcatataatagtaaaaacattacatcttgaacagtactcgttttgt

SEQ ID NO: 1960 - DNA, 57 bp; double-stranded, linear
aatttgaaccagacactgatacaagtcacacccagaaacttttaaggacgtaaatgt

SEQ ID NO: 1961 - DNA, 50 bp; double-stranded, linear
aacgctatattagcgatatacaatgatgccattatcaatantacanctgn

SEQ ID NO: 1962 - DNA, 60 bp; double-stranded, linear
tacaacgtcagttggcagacaccagaagaaggattcataagtatattcaggaacttgtta

SEQ ID NO: 1963 - DNA, 50 bp; double-stranded, linear
aatttttccccctttttaaatttcccaaaaaaaancccccaanaaaaaaa

SEQ ID NO: 1964 - DNA, 53 bp; double-stranded, linear
caacaagtagatgcatcagagagtagtgttcaaacgttaatagatgtggcatg

SEQ ID NO: 1965 - DNA, 54 bp; double-stranded, linear
agcaaaggcataactgctaatgaccatgtaaatgagacgagtcgatcgtggcca

SEQ ID NO: 1966 - DNA, 252 bp; double-stranded, linear
ctcaaataactggctcaactcaaccggtctataacaccataacaccgcatgccactctagcatactcaatcgctctggtaccagcnctcaaataactggctcacgccaactgtctataacactaacacgcatgcactctagcctactcagagctctggtacagcactcaatagctgactgtcacagtccacacacactcaatactggctgacacagttcacacacngcttactcgctctctatacattcatg

SEQ ID NO: 1967 - DNA, 59 bp; double-stranded, linear
cagtttaaactcgatgttgtgtactactgtgccagctggaatgttttataatggtgatg

SEQ ID NO: 1968 - DNA, 52 bp; double-stranded, linear
gttacatggcatcacgccaaacctgtctataacaccataacacggcattgcc

SEQ ID NO: 1969 - DNA, 58 bp; double-stranded, linear
acaattttaattatataactccaggggctacagtaatacgatttctccagactccaaa

SEQ ID NO: 1970 - DNA, 59 bp; double-stranded, linear
tgacgtataatggatgaaagtctattaagtttaagaagctaatactgtgaaatctttct

SEQ ID NO: 1971 - DNA, 52 bp; double-stranded, linear
tatcatgttatcttcaatcgttcaccaacagtcatttgctgcatcagtaacg

SEQ ID NO: 1972 - DNA, 58 bp; double-stranded, linear
ttgctggtgccatagactacacttgtttgatatcagaaatgggatctgttccattacc

SEQ ID NO: 1973 - DNA, 209 bp; double-stranded, linear
agttaaaccgagtccaacccaaacctccaatccacctaatggttaaaattccaaaccattaccagggagggaccaaaaaacggaatggggcctattggtagggtacctatcccatttaaaaatccatccaaaagcccanattatcggaccattttcgccaaaaataatttaagcggaaattgaataccttaaaattctcngggcccact

SEQ ID NO: 1974 - DNA, 69 bp; double-stranded, linear
atctgagtatttataacataaatcactaatatcgttattacatagggatagggtaaaagtaatctatat

SEQ ID NO: 1975 - DNA, 118 bp; double-stranded, linear
ttcctgcatccgagtctgaatcgctgtcgaatcacgtcgagtcgatcgctatcaggtcgagtcgcgtcgaatcgntcgctatcgagtcgatcgcgtcgaatcgaatcacgtcgagtcg

SEQ ID NO: 1976 - DNA, 400 bp; double-stranded, linear
ttgcaacntttgatctagatactaccttagttggattgtactacttgattctacttcacctttagttggttttgtagcaggcgttttgtctttacctgactcactagatgcgtcattttctttttcaacacttggtaattgtttattgtcatctttttggctgtcttgtttttgtgattctttttcaacaggtgatggtgttggtttgctaggcgtactggagtagcttccttcttagctgagttatcttgttgttcttttttgttagatttatcggtattggcttttgtaaatgcttctntatcaacgattctgacatggtattgtccatcataatcaatcgtttttacgtgaactttaacgatagcatcatatagagtttaccttcaacatatgggaa

SEQ ID NO: 1977 - DNA, 74 bp; double-stranded, linear
tagacaaagacagtaacagtaaagtacgcttcagaactgatggctcactgcgagtataaaaacttgtagtgtcc

SEQ ID NO: 1978 - DNA, 72 bp; double-stranded, linear
actcaaaaactcggaaaacattccaatttagcttaaatctgaccctttttttgacccttatattttttacaa

SEQ ID NO: 1979 - DNA, 69 bp; double-stranded, linear
atgtcattggctttgaactttatcttcaagcacccaatcgttttaacttttcaaaatttggcaccataa

SEQ ID NO: 1980 - DNA, 109 bp; double-stranded, linear
cagagagttgtcgctcattaaacgccacntgatgagttttcgcttacgaagtgccacgcggtatggataattttcacctgttgctgagtctttgataagcctcgactgt

SEQ ID NO: 1981 - DNA, 55 bp; double-stranded, linear
gtgcactacattatttcgtacggtccaatcacaacgtcgtgttaggtcggtatcg

SEQ ID NO: 1982 - DNA, 53 bp; double-stranded, linear
gaatctgttcaagttagaattatcccggcataatgataaaggcgagtaaatgg

SEQ ID NO: 1983 - DNA, 252 bp; double-stranded, linear
gncttttgaataaagaaaaattcatcaatagaaaaaccgtctttatcgtctatttttttaactagtaagttcggcgttcttagagactcaaatattgattttacgtttttctttgttacaccactaacactaaatattcttccatctaaatctactaattctggtaccgcaaagacatctaaaccatgtgttttttctttgtatttattttcatcttttcccaataaaaacacttggaacttttgatttngt

SEQ ID NO: 1984 - DNA, 63 bp; double-stranded, linear
cgtgttaatcaactaattcttagttttaactgtcgtaataatcaactgaacactttcaatcta

SEQ ID NO: 1985 - DNA, 63 bp; double-stranded, linear
tcctaaaatgaccgctaatgcctatggattgttatcaccgaccgcagggacagcacgacctac

SEQ ID NO: 1986 - DNA, 112 bp; double-stranded, linear
ggcatataaaaattagagaaattatttcaaatgaacagatagaggcacaagatgaattagttaaacgattaaacgattatgntttaaatgtcactcaagcaactgtttctcg

SEQ ID NO: 1987 - DNA, 106 bp; double-stranded, linear
tttatcaatttgtaacgaacatgaattacatgtttcaggaaaatatatttcatcccatttttaaaaagtataagattttatgaaaaattaaaccaattnagtataa

SEQ ID NO: 1988 - DNA, 400 bp; double-stranded, linear
aatggcgtagttacagcatttatgattgtgttaatcttttcttctgataaacataatctgtttgaccaaaagtatttaagtgttcaattaattagttttattatttacgtcgtatggcaagttttattgataatgttttattatcattcaaaaccaaaaaataattcattttcaaaatttgtaactgtaatggttttatcaatattgccattagcacttgtgaaagtgttacaaagtacatggttaggtggacatcagattcacttccatgaaagtaaattaattgaatttgttggtttcttaggaatttcttatgttacattcaaaagtgtgcagttaattatggaaattcgtgatggttctatcaaagaaattaaagtatggaaattaattcaattta

SEQ ID NO: 1989 - DNA, 400 bp; double-stranded, linear
ttcagcttacaataatgagcaggttggggtgggctccaacgcagagaatttcgataagaaattccacaaataatacaagttggcccactcccattctgtaataaatataggaggtcattgttatgcaaatagaacttactgatgcagcagtaacttggtttaaaaatgaacttgagttgcctgaaaataataaagtgctcgtgttttttgtaagatatggtggcgaattccaactcaagcaaggatttagtcctgcttttacagttgaaccaaaggaagatgttgatattggctatgaacaacaatatgacgatttaaatgttgtcgtagcggaaaaagatttgtggtactttgaagatgaccacattattgtaaatgtagttgtcacgaagatgaattt

SEQ ID NO: 1990 - DNA, 111 bp; double-stranded, linear
caatttattatgtaactaattatagcattgatgaacaaggcgctcaacgtaatantacaattaatggattgtttcacaagatggtaaagctaggatgtctttttattaaga

SEQ ID NO: 1991 - DNA, 54 bp; double-stranded, linear
taaacaaattcatcaattgttagtggcatatcctaatgtaattagagaggagtt

SEQ ID NO: 1992 - DNA, 59 bp; double-stranded, linear
gaacgatagattgatgaaaagtttaaaaaagtacgtatatgtttattaagtttgagttt

SEQ ID NO: 1993 - DNA, 73 bp; double-stranded, linear
cgagaccaaaatattcgaacgaataatttcagtgttttgctcctttattatagattcaagctatggataatag

SEQ ID NO: 1994 - DNA, 50 bp; double-stranded, linear
atccatacaaatgtaacaagcacaattgcngccatacttngcatgacagt

SEQ ID NO: 1995 - DNA, 57 bp; double-stranded, linear
tttgaaataaaatgtgcttattaccgttacaaccgttaacgggttttttatttgttt

SEQ ID NO: 1996 - DNA, 50 bp; double-stranded, linear
tcanttaanattaatgtncgttggggctctaataaaatttgtttacaacg

SEQ ID NO: 1997 - DNA, 61 bp; double-stranded, linear
tcatgatttgaaatgactttcaatgacttgggtgggacacttgttgcacagctggatgtgc

SEQ ID NO: 1998 - DNA, 50 bp; double-stranded, linear
catgcattgatgntctcaaagaacatgatgaaacaggtcancacatgnca

SEQ ID NO: 1999 - DNA, 52 bp; double-stranded, linear
ggttcgctactgattgggtatacatctgatttagcaatcttgcgcacttgtt

SEQ ID NO: 2000 - DNA, 53 bp; double-stranded, linear
atgtggttagatatctgcacacttgaacgttattgtgggatatacttggccat

SEQ ID NO: 2001 - DNA, 54 bp; double-stranded, linear
atctcagtaagggtaagcgtcaaagtctgcacggatgctaatgtttaccaggtt

SEQ ID NO: 2002 - DNA, 400 bp; double-stranded, linear
ctaaagattgtaatgcttgaacaattggttcagtgaatttttggaaattgtggaaactgttaccatcatcatctgttataaaactaaagtttaaattgccagtatcatgataaacagcgccaccaccagaaattcttcttactacatcgatgttgtgagcatcgatatatgtctgatttacttcctctatcgtattttgattctttccaacaatgatagatggtctatttatgtaaaataaaaagtaactttcttctgctggtaaattttttaaaacatattcttccattgctaagtttaaagttggatctgtaatattattattactaatgaatttcattacaatctctcccttatatctatatatatnctctacttatttatgccttaactttgctca

SEQ ID NO: 2003 - DNA, 57 bp; double-stranded, linear
ccgaaataggacgggcagttggatttattcgaaatgggtggcgttaatatatacagt

SEQ ID NO: 2004 - DNA, 112 bp; double-stranded, linear
nagtagttgaaggcgaccgcggtccacaagctgcaaacgttgttaaactataattcttagatttgaatcattgattttaactaacaccttaccaagaagtaaggtgttttta

SEQ ID NO: 2005 - DNA, 50 bp; double-stranded, linear
aaatcttgacataggcacaggaatgtatattgatctcgatcacttaagtc

SEQ ID NO: 2006 - DNA, 115 bp; double-stranded, linear
aaggtgggtttaaatttcccaaaaaaaaaagccttttaaccttttggggggtcccctttccttggaattggaaaggggccaaaattggaataaggggnttggaaaaacccaagcc

SEQ ID NO: 2007 - DNA, 105 bp; double-stranded, linear
tgaagaaatagcaaatgaactcaatatttctattgaacgtcaatatttcaaccaattatatcgcttcaataatcaagatttaaagcatcttgaacaagantttga

SEQ ID NO: 2008 - DNA, 67 bp; double-stranded, linear
attggctactaaagttaaggacatgatggattggattagtggtatgcgctttgaaaagatcaattat

SEQ ID NO: 2009 - DNA, 73 bp; double-stranded, linear
tataaattagcgtccttcatatcacaacgatgatgctctgtgcgaagatctgatttatttcaatgtgcgcacg

SEQ ID NO: 2010 - DNA, 51 bp; double-stranded, linear
ctttgtttatgtttcgtttaatttgtaaccctctctttggataccgaggtt

SEQ ID NO: 2011 - DNA, 88 bp; double-stranded, linear
taacgaccaagcttaaagagatacgctcttatgcgattggataggtcgttaaagttaactacaatacctcataagtagatttagaatc

SEQ ID NO: 2012 - DNA, 56 bp; double-stranded, linear
gtcaacccttgccaagcttatatcacgatactgggatgtgacttccggtgaattac

SEQ ID NO: 2013 - DNA, 400 bp; double-stranded, linear
agcttatagtacttgtgacttcataatggatgaagttgaagtaccaaaagaattaacacaattacacgaataatttaaatagagagtgtgatagtaggtggaattattaaatagttataattttgttttattcgtattaactcaaatgatattaatgtttacaataccagctataattagtggtattaagtacagtaaacttgattattttttcatcatagtaatttcgacattatcgttatttctatttaaaatgtttgatagcgcgtccttaatcatattaacttcatttattattataatgnattttgtcaaaatcaaatggnattcnattttgttgattatggcttcgcagattatccatactggtgccaactacatggatatagttatatatgca

SEQ ID NO: 2014 - DNA, 58 bp; double-stranded, linear
tctttcgaggacagtagagggtccaccctattggacgtggtactgtactacttttaaa

SEQ ID NO: 2015 - DNA, 55 bp; double-stranded, linear
tctacctgcaggcattcaagcttggcacttgccgtctttttacaacgtcgtgact

SEQ ID NO: 2016 - DNA, 66 bp; double-stranded, linear
tactcttaagctaacaacggcggttatgagtcctttgacaaggtatcggaggaaagaccgtaaagc

SEQ ID NO: 2017 - DNA, 105 bp; double-stranded, linear
ccaataagcacactgccattattgaggacggtacatntacggttagacccaattgttcatggcggtgggcacatagtgtttggctttgaggaggttaccattgcc

SEQ ID NO: 2018 - DNA, 58 bp; double-stranded, linear
ccttccaatagtaattgattgatgtatgagtatattaggtgtgaaatcaagaggattc

SEQ ID NO: 2019 - DNA, 52 bp; double-stranded, linear
tttcctcgtaggtggttcttcttcatcttcgttgttttgtccgaagtttgga

SEQ ID NO: 2020 - DNA, 50 bp; double-stranded, linear
atagtttaggtgaggatgttgnggtacgacaggaagaaagacggcaaaca

SEQ ID NO: 2021 - DNA, 300 bp; double-stranded, linear
ttgtcacaataatttcttcaggatcataggaaaaatgataacgatttttgaagtattgactaattgcttcgcgagtttctaataaccctttattgtgagagtatgatgtcttgtcattgttaatagcatcaatatatgcctttttcacaacatcaggcatcgggaagtctggttggccaatagttaaattaacacaatcatccaaattattcatacgatttgaaaattggcgatacttgggtggctcctaaaataattaggaaatgagganttnaaggaaggtttccatttngtggacac

SEQ ID NO: 2022 - DNA, 400 bp; double-stranded, linear
tcatccaaattattcatacgatttgaaaattggcgaatacttggtgctcttaaatatttagaattagaatttaaagaaagtttcatttgtgacacctcaaatataaatcaaatattgtctaaaaatttagaaattaataatatcataacatacttttaaagcaaaaaagggtaaattacttaagctttatttgaaaaacgaaaaatgtctaaatacactgtagtaactacttttcaaaatgaataaagtggttacagttaatgtacttagacagtataaaattatgaatctttaaactgtgatggtctttgtaaattaattattggatttgtccatttacaaacaaagtttgtagataatacatatacgatgattacagatatacttattaaataaagat

SEQ ID NO: 2023 - DNA, 50 bp; double-stranded, linear
ttnaaatataccaatcacgttcatccacagtgatcctagaccaatccaga

SEQ ID NO: 2024 - DNA, 66 bp; double-stranded, linear
tttttaatggtttaaaaattccctaataaaattttggaaaacctaaattccaaggggttaaattcc

SEQ ID NO: 2025 - DNA, 64 bp; double-stranded, linear
gtaagagcaatggcgcaaaatgcctgtaatgatattgtgaacgtaattgaatcagtagaggacc

SEQ ID NO: 2026 - DNA, 53 bp; double-stranded, linear
ctgtcgctgcgtgacttaattcttttgccccgttggcatatgaggaaatgtca

SEQ ID NO: 2027 - DNA, 53 bp; double-stranded, linear
catttcactattattggtttagggttgttcacgttcatcatgaccgcaccaca

SEQ ID NO: 2028 - DNA, 73 bp; double-stranded, linear
caactagacatagtattgctgcattaatcaagtcaagctgccacactaagaatcgatgcaaacggaatcgtca

SEQ ID NO: 2029 - DNA, 127 bp; double-stranded, linear
aataataattctggaatagtgtttaatacttattntccgtttaagatttcaacttaatatggtttacagcgcgtagctcgtctaattcatcatcacgtgtagagtgctctgccttatcagatcagtt

SEQ ID NO: 2030 - DNA, 61 bp; double-stranded, linear
gcaagtgaattgaagtgacatgtggctggtgcttcatggtaatgataaaccaacaccatgg

SEQ ID NO: 2031 - DNA, 78 bp; double-stranded, linear
ataaatatctatttagatataagtattgataagttgcttgaatttataaagtgaaggagtaggtgtcattagtatagt

SEQ ID NO: 2032 - DNA, 229 bp; double-stranded, linear
gaatagtgtttataaaatgttgacactgtagtggcatattgtaaattaaatattattatgtgatcattttgtttaaatattagttataagaagtgaaatantcattttaaaaggagacttaaaacttgaaacgatcaacgaatcaagaaaaatttcttgatacactaattagacttaatactaagattgaagaactaggaaagataaatattttaaataatcatatana

SEQ ID NO: 2033 - DNA, 57 bp; double-stranded, linear
ttttgtcatctgtataggtatgcgcgccggtgtctttattcactttgaactgtgcgt

SEQ ID NO: 2034 - DNA, 62 bp; double-stranded, linear
aaggcattggatataagacttgatgttgcatggcaatcacactgcctaatccttgcatataa

SEQ ID NO: 2035 - DNA, 52 bp; double-stranded, linear
atggcaaatactatacatcgtccaattgattgaaaaatatggttattaaaga

SEQ ID NO: 2036 - DNA, 86 bp; double-stranded, linear
aaggtgtttttatatgcttattacaaatacttaacgcgatgagtttctcaaccaaattgagaactctttctttatatcaccaacat

SEQ ID NO: 2037 - DNA, 71 bp; double-stranded, linear
tacccacccccaaacccaaggttttaaaaaaccccttccaaaagcccggaaaaaccaaaaggaattatttt

SEQ ID NO: 2038 - DNA, 50 bp; double-stranded, linear
gaatcccggaagtacaatttggtacgtgaagaaaatggtagtggaattac

SEQ ID NO: 2039 - DNA, 400 bp; double-stranded, linear
cagtatctcttggtattttaattggtgctttattaaacgtaattttacctttatatatcgatggagcgaagagtattttcgtatacgtttatagtgcgtctattttaccaggtatgattccttggtttatgattttattcagtcatttacgttttagaaaattacaccctgaagaattggaaggtcacccattcaaaatgcctggtggcgcagtaactaactatttaacaatcttattcttaatattagtattggttggtatggtatttaatgttgaaactagaatatcagtgcttattggtgtcatcttcttaacgattgtaacgatttattattttattagatataataaaantaatgtaaagcanaatagtatgttataangagcgntacttatgac

SEQ ID NO: 2040 - DNA, 79 bp; double-stranded, linear
aagctgatttttctaaatgttgaaaatcataaactgcttaataataaataacgagatctaagtaatagtgctccattaa

SEQ ID NO: 2041 - DNA, 54 bp; double-stranded, linear
aattgaacggatcgttcccaaccgttatcaacccagaccggtgtttgaacccaa

SEQ ID NO: 2042 - DNA, 50 bp; double-stranded, linear
aatgggattggttcaaactgaaatgggctgttagtccctgtaaaaccaag

SEQ ID NO: 2043 - DNA, 109 bp; double-stranded, linear
attggnataatcaaagcattgaatcatacatagtcacattgattgtttcctcagagtttcaacactctataactcattttagtaatttgctgattgcgcacttcatgtg

SEQ ID NO: 2044 - DNA, 50 bp; double-stranded, linear
ttttatggaggtgatgaagtgggtgaagctgaaaggaagcaaaagcttgg

SEQ ID NO: 2045 - DNA, 101 bp; double-stranded, linear
ttggcccccttccaacccttggaaattttaaaaggccanttttggggtaaaacccttggttccaaggacccccaaaagttttttaaccttccaattattat

SEQ ID NO: 2046 - DNA, 100 bp; double-stranded, linear
accctttccaaaaagcccattttgaattccccaaagggagccaaatttaagatggccgcnaaaaaggaccggggggtccatgttttaatttaagccggac

SEQ ID NO: 2047 - DNA, 50 bp; double-stranded, linear
gttagttatgagcaacgtattaatgaaattattgagcagtaattnaccag

SEQ ID NO: 2048 - DNA, 56 bp; double-stranded, linear
tacgtattttcaaatgacgttggtggacgtcacactccattcttctcaaactatcg

SEQ ID NO: 2049 - DNA, 82 bp; double-stranded, linear
ttttcccccccccccccaaattgggggttaaaattttaaaaaaaggggttaaagggaaaccccaattccggttaaccttttg

SEQ ID NO: 2050 - DNA, 51 bp; double-stranded, linear
tcagatggatggcagttatttggtattccatgggtataaagatagcatatt

SEQ ID NO: 2051 - DNA, 55 bp; double-stranded, linear
tgaacgggagaaagatgttgttgcatggtgtctcggaaacgtttgtgtccacgta

SEQ ID NO: 2052 - DNA, 74 bp; double-stranded, linear
atacctggatgcaaaggcaaagtcgcaattttccctgttctaatgtgtctaacttctcttctaaagttcaggtt

SEQ ID NO: 2053 - DNA, 51 bp; double-stranded, linear
aatcttgtctgatgtaatgttcaggtcccttgaccctcatatgcatgaggt

SEQ ID NO: 2054 - DNA, 52 bp; double-stranded, linear
catcgacttatagcttaattattataaaaaatttctccagatttaactttct

SEQ ID NO: 2055 - DNA, 400 bp; double-stranded, linear
actgacacattatattagtgaattattaaaaaatgatgagaaaattaaaatcatcatgaatgaattcggtacttttgatattgatagcaatagtatttcaaatgaaattgaagtccattcattgattaatggttgtgtttgttgcgatcttaaacaagaacttgtctatgaactaaaagccattgctttaaaaggggacgttaatcatgtcatcatagaagcgacaggcattgcgcatcctttggaattactagttgcatgtcaagatccgcaaatcgttaatttctttggaaaagccgattatttatggtgtattagatgcgactcgatttttagaacgtcatcaatataccgaaaaatacagtttcgctggatggggaggatccagttggaaactaan

SEQ ID NO: 2056 - DNA, 400 bp; double-stranded, linear
tcaaaactttgaagttgtgcttgctttgcaccatttttaaaatgttcagctgagagtatatcttccgctgtaaaatttacttctcctggacttaaagattcaattaacaaccaagccgataacgtatcatttagcaattgactcatgaaatcccaccttgttccctatttgttttttacttaatgctattttaacaaataatttaatcatattagtgttttttcaaaaatattcatatattatcattaccatatttattcaacaaatgtttgtaaaatcctcactaataaaattaatcgatatgaccataattcattatccaataaatgactataaaaatttctnctatgccttcatttgcaactaaatttggacatcaaaaaagagcactcctgaatga

SEQ ID NO: 2057 - DNA, 400 bp; double-stranded, linear
ttgttgttgtgatttcacattttcaaaattttgttgcatgttgttaacttcataaattagtgattcgactacatcattcatgaggacgcctcctacattttttaatttatcacaatatactgtattcgtcatgttttaacactctatataatttgatttaactattttttcaaatgtgttatctgttaaatcaagtaaatctaaaaacttcctatataaatacaaaattttatcgtgtatgttgttatacgatgaaaatacttttaatctaataaaatcatttaaatcaaatacacctctgctgattaacaacacatacttgtacttgcctcaaaaataaaaattactaatcatgatttgacttttataacaaaattcaaaaatattgtaatgagtattc

SEQ ID NO: 2058 - DNA, 400 bp; double-stranded, linear
tctttttactcgcaattttaggaaaaatggttggatcaattgataaaaccggaaaattattaacaataatcaataaaatatcaagcataataattattattgttgctctgatgatattacaaaaacttattcaattattattctaaagcgttatgtagttgtattttaaaagcgttatacaaaagacatacttgtgtctatgtataacgctttatttattataaatttggatcaattaactcaacaaatttaaatgttccattgtcatattcaaatttcaggatattacaattaccgatattatgctttaatgcttcatctagtttaaggcaatatcttaaaaataccncccttantggtccatgactcacgactaatgcattattctttggtttgagac

SEQ ID NO: 2059 - DNA, 51 bp; double-stranded, linear
aaaacaacacaatcaaaaatattggatacaactgaaaagttatcaaagcta

SEQ ID NO: 2060 - DNA, 50 bp; double-stranded, linear
ttatcatgtttagtagattttaagaagctagaacattgtagatatgatga

SEQ ID NO: 2061 - DNA, 50 bp; double-stranded, linear
aacgtcgtnatatcancttgccaaacaaagatattgtcaccttttatcgg

SEQ ID NO: 2062 - DNA, 50 bp; double-stranded, linear
accatggtgnatatggtcatgatgatcgtttgtgccgggagcttgagctg

SEQ ID NO: 2063 - DNA, 81 bp; double-stranded, linear
tttcccttggttttggaatttaaccaaatttgggagggatttgggaccacccccaggattttaaaaaaaaaaaatcccagg

SEQ ID NO: 2064 - DNA, 51 bp; double-stranded, linear
ttttggggaccttaactgggtgggtctggaactgtttccctttcaaacaca

SEQ ID NO: 2065 - DNA, 52 bp; double-stranded, linear
atgatgtattcaaaaggtatctataaaatagctttagttggaaaagatgaga

SEQ ID NO: 2066 - DNA, 53 bp; double-stranded, linear
tttcatcactggcatcttgtaatttcttggtctcatatctggaattaataggt

SEQ ID NO: 2067 - DNA, 63 bp; double-stranded, linear
aaccattaagaaattggatacacagagcaaatatggttatgattaggaaccatggcatttacc

SEQ ID NO: 2068 - DNA, 58 bp; double-stranded, linear
aaaggcagcgatgttactcataccgaacctggttatatatgagcgatgatgcaatgta

SEQ ID NO: 2069 - DNA, 67 bp; double-stranded, linear
ccatggcacaaaggactattgggtatggacgtggatcaaaactgggtatacaaataacgcaacagga

SEQ ID NO: 2070 - DNA, 86 bp; double-stranded, linear
catttaacccatcttctttttttaattcttctatactacggtttaaaaactctacaataactgccatttcatcatcatcaaagact

SEQ ID NO: 2071 - DNA, 381 bp; double-stranded, linear
gtttcttcaaaatatgtgtattacctttttgtatggttaaatcttttaattctatcattcttgtcttacctcttttggtgtatcctctttttcaacatatgtgatcgatatgacatattgccctttatgctttatttcgacatacgttctactaggtgaaaatccattaaatgttaatttataatcaagcttttcccctctttcactataagccgtaatattaacatattgttgcgtaccttttggcactttggcataactatactccgtttttaagaaaggattaaaacgatcaagtataggatgatgtatgantgtaaaagcaatagtaatggataatattaatcctaataatattgcaatgataaatttcatagttaa

SEQ ID NO: 2072 - DNA, 52 bp; double-stranded, linear
atccccgaattgcttcgcaaatgtatcatcttcgaggctacgttacttaaat

SEQ ID NO: 2073 - DNA, 82 bp; double-stranded, linear
ccaaaaacagcatcactgtgattatggttttcatcttctataactaagaatacatgtttttttgtaaaaatttttttgatca

SEQ ID NO: 2074 - DNA, 82 bp; double-stranded, linear
tttatcgcaatgagggaagataaaggatcccgaaagcgccgtatgggttggcaaacattggggaccaagaccgttccccata

SEQ ID NO: 2075 - DNA, 66 bp; double-stranded, linear
cttggttgctctttatttatttaattgagacctagaaataagttattaagcacaatcattcacttt

SEQ ID NO: 2076 - DNA, 57 bp; double-stranded, linear
ttatagttgcaacgatatttagcatcatcgccataattatgtgttgttatttagcaa

SEQ ID NO: 2077 - DNA, 326 bp; double-stranded, linear
tacgttctatcatagagcctggagatgaaattataataccgggaccaatttatgcaggctacataccactcatcgaagtactaggtggtaaaccaatttatattgatacaacagcaacacaatttanaattacacctgatgcattagaaagtcatatttctccaaagacaagagctgtcttgttaaattatccgactaatccaactggcgtagttttaaaaagaaatgaagttytaratatcgtaaatgtattaaaaaaatatccgttatttattattagcgatgagatttatgctgaaaatacatttagtggtaaacatgtatcc

SEQ ID NO: 2078 - DNA, 56 bp; double-stranded, linear
accccttaatttaattgatgttttgttatttttaaaatgaatagttgaagaaaaat

SEQ ID NO: 2079 - DNA, 61 bp; double-stranded, linear
cacgtactgccatgtatgcacaagccggcattcataaagccttccatggcagtcgttatca

SEQ ID NO: 2080 - DNA, 94 bp; double-stranded, linear
tgggacagggcgtaccatttcaaaatgatagttctgagctgctaattaatatgccttcgaaaaagatgagtttaaatttagatgatgagactga

SEQ ID NO: 2081 - DNA, 50 bp; double-stranded, linear
aagacgacatgcaagacattgccttatctaatgacaatgttaaagcgagt

SEQ ID NO: 2082 - DNA, 50 bp; double-stranded, linear
ttgttcggctaaaaataaagtggcattgacgtgaccgcaagttgacgtac

SEQ ID NO: 2083 - DNA, 133 bp; double-stranded, linear
cttcccaacattgcgcactgaatggcgatggcgctgatgcgtatttctcctacgctctngcgtattcaaccgctatgggcatctcatacatctgtcgatgcgctattaagcagcccgaaccgcacaccgtgag

SEQ ID NO: 2084 - DNA, 57 bp; double-stranded, linear
ggtaggggcactattttgtatgtagaggttttgtcgggcagtgtgaaatcaacgact

SEQ ID NO: 2085 - DNA, 56 bp; double-stranded, linear
ccccccccaaaaaccgccccccccaatttggcctttttccaaggggggtgttttaa

SEQ ID NO: 2086 - DNA, 114 bp; double-stranded, linear
aatagcgagagcccgaccatcgcctccagattgcgactgaatggcaatgcgctgatgcgtatttctcctaccatcgtggtattcaacgatatgggcactctcatacaatngctc

SEQ ID NO: 2087 - DNA, 80 bp; double-stranded, linear
aagggggaaaaggaacccaaggcccccttcccaaggaaattggggggttggaaaaaaccaaaaattttttaaaaacccgg

SEQ ID NO: 2088 - DNA, 66 bp; double-stranded, linear
ggggtaagtggttgagacaggaactttacaagaggtgtttcgtcatcctagaacgacgcttgctca

SEQ ID NO: 2089 - DNA, 62 bp; double-stranded, linear
atcaatgtattacgtatcgaaggtgaattatatcatactgctaaatatgacggtttcacatc

SEQ ID NO: 2090 - DNA, 50 bp; double-stranded, linear
gaattcgctatcctgaaatcctgagtcgctgtcctgaaatctgaaatcgc

SEQ ID NO: 2091 - DNA, 74 bp; double-stranded, linear
cggggttcccccgttcaattccctttgagttttcaaccttgcgggtcgtaattccccaggccggaattgcttaa

SEQ ID NO: 2092 - DNA, 70 bp; double-stranded, linear
attgttgggtacggtggtgggttaataatccaaacacgttaaactacccgttttagatatacctatacaa

SEQ ID NO: 2093 - DNA, 88 bp; double-stranded, linear
gttttgggtcttgggtattagtttaatctccatcatggttaattggtatggtattggtattagtaatcatgtatgatgggctgggcgg

SEQ ID NO: 2094 - DNA, 52 bp; double-stranded, linear
tggccattgaggcgcattacgtactacggcttgtcgtagggacaattattat

SEQ ID NO: 2095 - DNA, 85 bp; double-stranded, linear
agttgatgcaatgagtgatgcaaggcgactgaaaagttggtatgaatgacaaaactttaataaggtgcaatttattgcaaaaatg

SEQ ID NO: 2096 - DNA, 53 bp; double-stranded, linear
acttaaaatctaatacggtattttcaaaaacgaataaaagttacctcttgtct

SEQ ID NO: 2097 - DNA, 50 bp; double-stranded, linear
aacttaatattgctacgatatgaacggcatnaacatacttagcgntgntc

SEQ ID NO: 2098 - DNA, 72 bp; double-stranded, linear
caaaataagaaattaattaagaaaatgccaagatgccagatgccatcggcggaaaggaaattgcacgtacgg

SEQ ID NO: 2099 - DNA, 78 bp; double-stranded, linear
ccacccaaacccaaaaaataaagcccaaaaaattgccaaggaaggaaaaggaaaattgtttaaccgccaaagttttaa

SEQ ID NO: 2100 - DNA, 208 bp; double-stranded, linear
caccaatttcttctggngctggatctcgacctaagtcctgtaataattgacgttgaacacgaattaatttattaattgtttctaccatatgcacagggatacgaatcgtacgtgcttggtcagcaattgcacgagtgattgcttgtctaatccaccatgttgcatatgttgaaaacttaaatcctttgttaaagtcaaatttttcaac

SEQ ID NO: 2101 - DNA, 400 bp; double-stranded, linear
taatgaaattaagtaaaataaaaattatttcatggattgcttctatctatatcgaaatattaagaggaacaccaatgttagttcaagtatttatcgtattctttggtataactgctgcattaggactagacatttcagctcttgtttgtggaacaattgcattagttattaattcctcagcttacattgctgaaattattcgtgcaggtataaatgctgttgataaaggccaaatggaagccgcacgtagtctaggtttgaattatagacaaacgatgaaaagtgtaattatgccacaagcaattaaaaatattttaccagctttaggtaatgaatttgtcactttaattaaagaatcatctattgtgtcaacaattggagttggcgaaattatgtttaa

SEQ ID NO: 2102 - DNA, 52 bp; double-stranded, linear
agtgtttgtatagccttggtaacggcccatacgtgttcgcttaggtatgtaa

SEQ ID NO: 2103 - DNA, 400 bp; double-stranded, linear
tttaaggagaaaggtcattggtataatcttgagaaagagtggcaagagttcttaaactctgggaaagaggtgaaaaatattaaaatggaagtaaaatatagcggtaatagtcaaagaccgactatatttaaagttgaatatgaaattaatggtgaaagaaatattagaagaatattaaataagtagaggtgccaacatgacatttgaagagaagcttagcaaaatatacaatgaaattgcgaatgagattagcagtatgataccggtagagtgggaaaaagtatatacaatggcttatatagatgatggaggaggtgaagtattctntaattatactaaaccaggnagtgatgacttgaattattacaccaatatacctaagggtataacattccggtgc

SEQ ID NO: 2104 - DNA, 53 bp; double-stranded, linear
aaccatcataaaatgttattaaaccgtcatggaccgcgtcaccatttagtcct

SEQ ID NO: 2105 - DNA, 116 bp; double-stranded, linear
aagcacaaattagcagagtgttttaatttaaatgaacaagtacctttacaatttttggataatgtaaaagttggtaaaaataatatttatgntgctttggaagagtttgccaacaa

SEQ ID NO: 2106 - DNA, 61 bp; double-stranded, linear
aatttgcaaaagaatcatggacaattgaaagcaaaaaggatcatcattaaaattgaactgc

SEQ ID NO: 2107 - DNA, 60 bp; double-stranded, linear
gaaccaatgttaagctaattaatggaatcctaacagcgttaatctatttaaaaaacttaa

SEQ ID NO: 2108 - DNA, 126 bp; double-stranded, linear
atttganaatgaatctgtggaacattttgctaatcatgaggataaaatcatatgatgttgaaagcgagaatgggattacgttaaacgtgggcgctgctaatttaagcaccttatttagtggaagat

SEQ ID NO: 2109 - DNA, 400 bp; double-stranded, linear
ataatgttaaaaaaacggcaactaatcttttcatactaacaatgattatatgtacaataataacgtacttattgtataacaactattttgttgcaatgatggtttattatgtcgttatatcgttaataatgctagataattttaaaaaaatgaaaaaccgtgaatatcaaaaagaaatagcagaaaaaaatagacatattaatacattaattgctgaacaagagcgacatagaattggtcaagacttacatgatacgttagggcatgtgtttgcaagtttatcattaaaatcagaattagcttataaactaatagatgctgatgtaganaaagtaaaagctgaattattagcaattaataaattatctcgtgaatcattgnacaaaagtcgagaaattan

SEQ ID NO: 2110 - DNA, 61 bp; double-stranded, linear
aagatttaatatcgggggtaatgttgattttcaaatatcgcgatgtgcttgtaccaccatt

SEQ ID NO: 2111 - DNA, 55 bp; double-stranded, linear
tatactaaattatggcaacttggctcatataggtcgagttaccagacatattcgg

SEQ ID NO: 2112 - DNA, 400 bp; double-stranded, linear
cgaataagttctgggccttttgttgttcattagcttgtttctgttttgattgttctgccatttgaactacaccaaccttttaaatttattctagtgacaggataactaaaatatatttcttatgcaataatttcctattgataagcattttcagattttagttgtaaattttgccctaattcatttaagtcttgttgcatttcaaattcagtattgtaaacacgcattgactcatctccaaatttataaagaataaattcgtctcctctttgacctataatatattgancattataagccatgcgattcattccagacacagccataaactcttgtttatctatcattttaaataccatttttaatttggcttaatgggacattccgtattaaatcattt

SEQ ID NO: 2113 - DNA, 87 bp; double-stranded, linear
tgttttcaaagcatggtataaatgctttgtaacataggttttgcctacatcagtattcgtacttgtaataaaaatcctcataaaaat

SEQ ID NO: 2114 - DNA, 50 bp; double-stranded, linear
tttacaagttaaatatancactaaaaatttttaagtcaataagaatatat

SEQ ID NO: 2115 - DNA, 52 bp; double-stranded, linear
tgtgcataaaatccttttactttttgtaattgattgttatctttaacaatta

SEQ ID NO: 2116 - DNA, 113 bp; double-stranded, linear
atttanaacccaattccccattattttttaaaacggattccatgggtggaccattggaaattttaaaaaaaccatggccccattccaaaaagttaggatggccaaaaagcctt

SEQ ID NO: 2117 - DNA, 93 bp; double-stranded, linear
gatttatcaactatttccgtattttgattatctccatacaatttccaatcctctggcttatcaataaataatgataatggcttatctttcgat

SEQ ID NO: 2118 - DNA, 50 bp; double-stranded, linear
tgattaccttganacatgactttncctgantggtaaatatttacagttgt

SEQ ID NO: 2119 - DNA, 217 bp; double-stranded, linear
agatataaaatataaaaaattattaaaagctatatccaatcaagactttaaagggttagttccaaatatcaatcagaatgataattatnctgaaatatatataattaacaatactaaaaacttaatatatcatttatatgatgatagaggtctatggctagcttttaataataatgaagattatgcaagatatnctgaaaaatataatgatttaata

SEQ ID NO: 2120 - DNA, 75 bp; double-stranded, linear
agacttagtaaagttagatcatctaaagatgagcgtaaaatttatatttatttaaataatggatgatatatctaa

SEQ ID NO: 2121 - DNA, 87 bp; double-stranded, linear
caccacctacatttactatataaaatgtaggaatggtagattgatttagataaactggacgtatcactttaagtgctttttcaaaga

SEQ ID NO: 2122 - DNA, 70 bp; double-stranded, linear
tgttctttagctaaagctttagcttcttcatcacttttaacttcataaaaatctacaccagtagcttctt

SEQ ID NO: 2123 - DNA, 50 bp; double-stranded, linear
tanatctaaaaggagaaatgctgaagatgagagaggtatttttgaaatgt

SEQ ID NO: 2124 - DNA, 63 bp; double-stranded, linear
ttaaagggtaattgttttaaaaaaagattaaaccgaggacttttaattgttaaaaccatccct

SEQ ID NO: 2125 - DNA, 78 bp; double-stranded, linear
tgtaaacgactattacatgatcacaatccattcagcgccattatataaaggtacttaatataggacatcattcgcagc

SEQ ID NO: 2126 - DNA, 50 bp; double-stranded, linear
tttggtcgtgtgcaagacagaagtcgacatactccaatgaaacatcatgt

SEQ ID NO: 2127 - DNA, 50 bp; double-stranded, linear
tttgtgtcgatgcgctttttcacttcttctgaatgctcgaaatcattcgt

SEQ ID NO: 2128 - DNA, 50 bp; double-stranded, linear
tgtctgaaatgatcattaggattgctccagctcaatgtcagtngnaatga

SEQ ID NO: 2129 - DNA, 65 bp; double-stranded, linear
tccaattacctacaaagtgagtgctttcttgaccaagtcaaaacgaacttttatatttgtccaac

SEQ ID NO: 2130 - DNA, 61 bp; double-stranded, linear
ttccaaggtgtcgctgactttcaacacactgaatatatacctgccagtcggctggtcatgc

SEQ ID NO: 2131 - DNA, 92 bp; double-stranded, linear
agttcttcagtccaaatgcggcatgttgacccaccataggcgagggcattttcaccacggggcggtttgcgctttacacgttacagacttat

SEQ ID NO: 2132 - DNA, 400 bp; double-stranded, linear
cccctcgagttttttttttttttttttttactggagcaaaatgaattttttttattgtacttcagggcaacaagtcaacagctgcaggaaaacaaaaccaggtccaatctatgatctaagaggaagtcaggaaaggcttggaagagagatccaaaggccatcctggcaaggggaatcccacatgagaattcctgggagagagcaggccccaggcagcaaggtcatcttgcctgcttctctgtaagttaatccttcacagggagccaaggcttctcttgactgcttggacaagagggtaagggccctggttgcaggatttgccagtgaagtcatccatgtcaatagaccagatcatggctcctcccaggttaaattccttaagaactgaaccttgnctcca

SEQ ID NO: 2133 - DNA, 50 bp; double-stranded, linear
ttcatcatacaacattacactttgtatgactaaacccaaattaacgatat

SEQ ID NO: 2134 - DNA, 59 bp; double-stranded, linear
gtggcaagcttttttaaggtctgactgccatcgacggatctatgttaacaggtggatct

SEQ ID NO: 2135 - DNA, 50 bp; double-stranded, linear
atcaaagtcatctncatggtcnatcacaccacgctttatatggtaattct

SEQ ID NO: 2136 - DNA, 52 bp; double-stranded, linear
cgggatctgaggtcgctatctgcaatctgcaatcgctatctgcaatctggag

SEQ ID NO: 2137 - DNA, 50 bp; double-stranded, linear
nctcaaccacccacacaacaacacaacaagcagcacccacacaccacaca

SEQ ID NO: 2138 - DNA, 87 bp; double-stranded, linear
tgtattgtcattgtagacgtgtgtagccaaatcataagggcatgtgatttacgcatccaccttctcggtttgtaccgcagtacttag

SEQ ID NO: 2139 - DNA, 77 bp; double-stranded, linear
ttcaccgttgcgcaacgttcaagtttgaagttcgtttggcatgttgaaataagcaccagttacaccaaaacgcccag

SEQ ID NO: 2140 - DNA, 148 bp; double-stranded, linear
atcttctaacattcacttagtagcgtnatttttcgcttataatgaaatgttaagcatatgcgggatttatattttaaagagacctttagataccatatatacctaggttattgaaaatatggataccttatataagtgatttgcaata

SEQ ID NO: 2141 - DNA, 50 bp; double-stranded, linear
gctggcacatagatgatcgtcaagtcgatctcgccagtctgaagtcaaga

SEQ ID NO: 2142 - DNA, 60 bp; double-stranded, linear
ttgttgtaaatactatcactgtacatgggtgctatcaaaatattgtcagttcgtaaaata

SEQ ID NO: 2143 - DNA, 135 bp; double-stranded, linear
gtagtatatcttattaattgtatcatgaagcaatttaaatatcatgacaatttagtttgaaaaacacactttgtgttgacgttgtgttttatgggatatagnatagtaaggaatgtaaaatgaaggagtgaatgc

SEQ ID NO: 2144 - DNA, 57 bp; double-stranded, linear
ttttaaggtttgaagaaaaaaagttttaaaaattcaaggaaacattaaattaattta

SEQ ID NO: 2145 - DNA, 148 bp; double-stranded, linear
tttcgaaagtttgatagtccaccttacattctcctactattttctgatgtcccaatactttatattatttaaagtaatataaaagcaatctcttttgaagacatgttaacctaaatatttttatatataatatatatataaaatatan

SEQ ID NO: 2146 - DNA, 50 bp; double-stranded, linear
gttaatacaatacggttaacagcacctttacgntagttgctttnctgcan

SEQ ID NO: 2147 - DNA, 68 bp; double-stranded, linear
aatcccctcttttctctatttcctaaatcatagaacttttaacagtaaaattcaatcattaatacatg

SEQ ID NO: 2148 - DNA, 92 bp; double-stranded, linear
aggtccatttgtaatttataatgttgactaataacatctacagaatttaacgttcccatacctcgccactgattgtaaataaacaaaccata

SEQ ID NO: 2149 - DNA, 69 bp; double-stranded, linear
accatccattaaatcaggatcttcactaataagtgctaaattagcagcgccacgtttaacgtaatccat

SEQ ID NO: 2150 - DNA, 384 bp; double-stranded, linear
acgcccaataatttagttcgattangtagtgctgtgattagtttaataatcgcctgcgattcaaaatatatacgatcacctttctgtaaaatcacactatttttatttgccgcttctggatgttgtttaaaaaattgttggccaacttcaccttttaacgtggcaaattgataatttcttggtaggtcatgttgaattaaccaaatgacatagttataacaatatatacagtttccatcataatatacgattggcataatttattcgctcctttaatagtacttatagtcatttttcctaatttaaaaacatttaaacaaggttgtcacttgataagtcctcgcgacacgaaattgccataaaatttatttttcagnttnatat

SEQ ID NO: 2151 - DNA, 83 bp; double-stranded, linear
tgttgtttatcactatattttaaaaatagtctataaggcttatcagatgaagtagctgctggcgtaacaccaccagtaaatgt

SEQ ID NO: 2152 - DNA, 73 bp; double-stranded, linear
gtattcgtacatttttcagcaattaaccaagatggttacaaatcattagaagaaggtcaagctgttgagttta

SEQ ID NO: 2153 - DNA, 50 bp; double-stranded, linear
cccccctcccccctccccncccccccccccccccccccccgccccccccc

SEQ ID NO: 2154 - DNA, 55 bp; double-stranded, linear
tattttaggcttagcattgatgatgttgctcattttcaataatataggaattatt

SEQ ID NO: 2155 - DNA, 68 bp; double-stranded, linear
atgcttgctgatataatgtaatagcgtcgtgataacgttgctggcttataatatacatttgcgagatt

SEQ ID NO: 2156 - DNA, 68 bp; double-stranded, linear
taatctttgtcgtcgaaatacaaactaacttttgagtttaatgatgaaggtacgcattgtgtatcact

SEQ ID NO: 2157 - DNA, 400 bp; double-stranded, linear
tcattcattttcctcttttcttttatttaaaatgttcatggttgtttctcttaattctgttctaggtataaagttttcagtcaacatttctggaatgatattattaataaaatcttgtacagatgctaaatggtcaaattgaataattgtttctagactcatttcataaatttcgaaaaataattcttcgggattacgtttttgtatttctccaaatgtttcataaagcaaatcaattttatcagcaactgaaagtatttggccttctaatgaatcatctttaccttcttgcagtcgttgcttataaacatctctatattgtaatggaatttcttcttcaataaaggtctctaccatttcttcttcaacttgcgaaaataattttnntaattcactactc

SEQ ID NO: 2158 - DNA, 232 bp; double-stranded, linear
tatttttttcttctaggcagtgttaatactgcttcaatttgttttttactaaattgatatttctctatgattgaattaatcaattgattgtccatttacttaacccacactttttcttaaatttactcatttattttaacatattctaaaatacttctattaagatatgatacttaatgtaattttcacttccaaaacatttaaaacgaatgattaggncatactatattnt

SEQ ID NO: 2159 - DNA, 60 bp; double-stranded, linear
ccgtttttccaaaaacttgatcataaacccgctccttttttcatcataacaaaataagaa

SEQ ID NO: 2160 - DNA, 60 bp; double-stranded, linear
cgatttactgcacgacacattgccacatcctggatgggcaatcttttctcttacccgtct

SEQ ID NO: 2161 - DNA, 400 bp; double-stranded, linear
attagttgaagtttttgagcaattgaaagatattcagggtcaaataaaaacgacaaaaaaagaatatcaacagaccaacaaagaactttctgctgtagataaagaaattagaaatatagaaaaagacctcantgatacaaaaaaagcacaaaatgaatacgaagagaaattgtatcaagcatatcgatataccgaaaaaatgaaaacacgtattgatagtttggcaacgcaagaggaagaatatacttattttttcaatggcgtcaaacatattttgaaagctaaaaataaagaattaaagggtatttatggtgcagttgcggaaattattgatgtgccatctaaattaactcaggcaattgaaacagcattaggtgcttcattacnacatgtcattgna

SEQ ID NO: 2162 - DNA, 66 bp; double-stranded, linear
gtgcgtaccattgtaatcttcgtaaactgggtaattattttgtctttcttcatcataaagtaataa

SEQ ID NO: 2163 - DNA, 72 bp; double-stranded, linear
agaatggtaacatggtaataataaaatataaacagaatactagttaatacactttatactagaaaaagatat

SEQ ID NO: 2164 - DNA, 325 bp; double-stranded, linear
cgataatctgtttttttaaatctgttgctgttagatttagcaccgattcgtttaacttcaaataatttttattacctttggaagaaagtggaactattgtaactgtttcttttcctttattgtctttgttatctaatattacacaaaaatgattaccagaaaactcacttccaatattactccctagttttacatataccactgttcctctacnatatgatttataatatctttntttattgcttgtaacatcgctatgtatagcaattggaataaaactctagccaatgaggcatgtntataactttcatgtttttactgtcgg

SEQ ID NO: 2165 - DNA, 121 bp; double-stranded, linear
taaaccccttttgggtaaaaaagtttgggaaaatttccccggggggaaaggcccccaaaaaattgtgcccctccncgggggaaaattaaaatttccccccttttaaaagggtttccccttt

SEQ ID NO: 2166 - DNA, 52 bp; double-stranded, linear
cggacagttaaatgaactgttcaatgagcccaggatgttgtaaatggttcgg

SEQ ID NO: 2167 - DNA, 53 bp; double-stranded, linear
attacagtaaaaaatggattaacattacaagcgtgtcttgctagagcagccaa

SEQ ID NO: 2168 - DNA, 114 bp; double-stranded, linear
aaagattatttatttgcagtcattaattgtgatttaatacggtcagctttgtttgaatgtattaaattacnttgagcagctttgtctactaacttaactgctaagcttactaat

SEQ ID NO: 2169 - DNA, 215 bp; double-stranded, linear
aaggaaccccccccccttaaaatttttggtggttttaaaaaattcctttggatttattacctttattcctatnattttccgtttggattttcctggattaaatttccccattaagccatttccgcttcccttattttatnattttccaaaatttccaaaggttccatttgggattttggcaatccttttttattaaaatggcctaaaaatttttt

SEQ ID NO: 2170 - DNA, 114 bp; double-stranded, linear
tatcgtttttagaaatggatgttctctccaaagatgatggtatctaacattatcttattggtatcattatgcaaccnttacaaaacatttacgcaagatgatacattatccaac

SEQ ID NO: 2171 - DNA, 76 bp; double-stranded, linear
atcacagatgagataacagatccactgtaactttacaataaataaatggtatcataattaacacgtaaatggtttc

SEQ ID NO: 2172 - DNA, 64 bp; double-stranded, linear
attatcacaaaatgttgacacgcaaaaagttggtcagttatcaatatggtatataaatctgaga

SEQ ID NO: 2173 - DNA, 61 bp; double-stranded, linear
aaaggccaaccaaccaaaggccaaaattaaccggccaattccaaggggttaattaaacccg

SEQ ID NO: 2174 - DNA, 400 bp; double-stranded, linear
aacaagtatcttcactgcccctaaggagatcgcagagatcaagtaagtaccatccctctgcaccccgcactctcccatcttttacctactggcttctttgcattgccctggcacctccgtcctcagcctcccaggctgtattcattcattcccttactgagcacgcaccatacaccaagcaccattcaaggtgaaccagtcaaatgaaggcctggctcattttaatgggggacaatgagcatttttgttacaatttcatggagtgatgagtgctgtgaagaactaaacaggtcaggtgtaagtggctcatgcctgtaatctcagcactttgggangccgaagcaagtggatcatttaagcccaagagtcaagaccagcctggggnnacatagtgagantc

SEQ ID NO: 2175 - DNA, 400 bp; double-stranded, linear
atatcgtttaaaccatcaacaagattttatagatgcaacttttactgcgctgaaatcagatagagcacgtttaaaagaagtgccagttcatgttgaacttataagttatatttctaaatcaaaataaactgctatctaaaacgcaaagttgatcaaaatatcgattttgtgttttttattgagaaattatataggagtgtcaatcgatgatttattgtgaacagagcgtttaatattaagagactggcatgaagatgatctgttaccttttcaaaaaatgaatgcgaattatgacgtacgtaaatattttccaagtttattgagttancgncgttcagaattagatatgagacctatggatgcggttatnaaagattatggccattgggattattgccng

SEQ ID NO: 2176 - DNA, 71 bp; double-stranded, linear
taaatcaaggaaagacattttaaggtacgaaggttgataacaaaaaaccaacagatttaggggtatcagag

SEQ ID NO: 2177 - DNA, 51 bp; double-stranded, linear
gttgaattaggcagcacgattattgatgctgaactgttagagtcagataag

SEQ ID NO: 2178 - DNA, 61 bp; double-stranded, linear
ttaattaatggtatttacatattcataaccaaaggataaaataattgtgaaattattcaca

SEQ ID NO: 2179 - DNA, 50 bp; double-stranded, linear
cattttaccatgcagcaaataatacaggtggtgccgttaacaaacgtgan

SEQ ID NO: 2180 - DNA, 73 bp; double-stranded, linear
gccgaacgaatcaaataccatacctaattgactgcaggcatgtccatatagtgcagttaactgtctacaaggc

SEQ ID NO: 2181 - DNA, 301 bp; double-stranded, linear
tacttttggcgatattcggtatcgttattacagttattttatatgcaattaaattgccgggttctatctttatcggtatgatcatcacagcaatcgttggtatgttcactggattgattcaaatgccatctggtattgtgggtaagattccaagtattgaaccaacgttcggtgctgcatttgaagcgtttaaagacccaagtcaattattaacgatacagttcttaattgttattttaacgttcttatttattgatttctttgatacagctggaacattagaagcggttgcancncangc

SEQ ID NO: 2182 - DNA, 54 bp; double-stranded, linear
ttgattcgccttggccagaattacttttgttttgggcgtcattgcaagtttcta

SEQ ID NO: 2183 - DNA, 118 bp; double-stranded, linear
ttagtnacattgggacatttaactgatccaccagtacttttggcgatattcggtatcgttattacgttattattgcataatgcggtcactacgagacaccgcactgagtccgatatca

SEQ ID NO: 2184 - DNA, 303 bp; double-stranded, linear
agatagttatataaagatttcatcttctgtattacattgatatttttaggtccctgtatataaaaatcatatgcctcatcaacaacatcacttttatttttgattgcaatttgatgtaatatcttttgactaaaaacacgattaatcatatttctattatccatagctacgcacctccttcaacatacatttaatgcttatcctgttaatattataancnattttaaatgcctatagacattatttctatacacatacgattatnaaattgtattgaaaccaaatgatggttgccaaacacat

SEQ ID NO: 2185 - DNA, 110 bp; double-stranded, linear
ccggggttttggttaaaccctcccaanattttttttaagcccaaaccttggaaaaacccaggccacccgttggaatttttaagccttggattaatccggtttggttaacc

SEQ ID NO: 2186 - DNA, 86 bp; double-stranded, linear
cctatattgtcacccaacttcattacggcacctttaccgaaagatttctccatatttttaattactgtatctaaagctttttgacg

SEQ ID NO: 2187 - DNA, 400 bp; double-stranded, linear
tttgctagaaaacataccacatttgccaattatattatttattctgatgtttattttcggagtaccttctgaaatgataaaagataggcaaaggaaaaataacggtgtttaatttatcgatatttagaggtgataaaatttgtcaactattacaaagactaaaataaaaatctttattaattattttattggtatattagccttggcgtttgctgcttatatattatttaaataaaggttagagtgaaacgtgtttatgaactagacgttctagtatagttactacagctttagtcagaaggtatcattgataagatcatattaaatcaaagaggcattgatatacactaaaaagaggcaagattacctgcctctttttagtnattaaatatacgtgtta

SEQ ID NO: 2188 - DNA, 131 bp; double-stranded, linear
ttttataaaatatcagacatttttgntcaacatacatctctttcgatgtttctaatactttatcattaaccattacaccttaaagttatgatgtggcatgttttcttatattcataacatcaattttatca

SEQ ID NO: 2189 - DNA, 85 bp; double-stranded, linear
cgtaaaatattttgatttaaaatggagggtattaatatgaaaaggttcatgtaaaatctaggggtattccaatattataaggcac

SEQ ID NO: 2190 - DNA, 224 bp; double-stranded, linear
cccgaggaatacatggcattaaatacacgtttaatatttataaaggtgacttaattttgttcaagttgattttaccacgcttttttctttattcactaagacttttgaatgaagtttaaaataattgtttatcagtgataaaatatttgcaataagaagagaatgactaaataatcttaattttcaganaagtaattgtaaccttactggtcttatggtaatan

SEQ ID NO: 2191 - DNA, 400 bp; double-stranded, linear
agcttttgtagttttcttaagcacaccggcgatttgattattacataaaggattccctttttttgttgtgaatatgaaccctctgtcaacatagctcgaattccatcttttcaacattttgttttccagtattatctttttaaaaatttctacggttctagaattgatgctgatacttctttttgaacttatagtctttgtagtgtctttgtatccgaatcctttctcgtatttaatgcggtgaattgtacctgttatattgatagtnttgtttaataaatctatatctttttcctgcagtgcttgtagttctcctatgcgcataccagttaaagcctgtacttctaagatgctggcaattaaaatgcgatttcgcttttgtaacttattatcatttagt

SEQ ID NO: 2192 - DNA, 50 bp; double-stranded, linear
gacgactgagaggccgttgaatttgacgttgccatatnttcaaatttaac

SEQ ID NO: 2193 - DNA, 60 bp; double-stranded, linear
gttgttttcatatcaaaacaccgtagaataaacaatgaatggaattacttttgcaatgat

SEQ ID NO: 2194 - DNA, 56 bp; double-stranded, linear
ccagtcactgactacgtcttcctcggtgctggcggtggagccattcccttattacc

SEQ ID NO: 2195 - DNA, 69 bp; double-stranded, linear
gtagggaaaggaaaaactgcttccattgggaaatgttaaaccttgttccttggtgatgccattggattt

SEQ ID NO: 2196 - DNA, 55 bp; double-stranded, linear
atatgacactatattttataaacatacatttaatgattcattatacaattgccaa

SEQ ID NO: 2197 - DNA, 71 bp; double-stranded, linear
gccctagttcaatcatataaccatctttacgatacgattgaatctttccccccggacgattcgatgcttca

SEQ ID NO: 2198 - DNA, 54 bp; double-stranded, linear
agtagcacaacagccatgcggagacagagaatcgttagagattaatggagatca

SEQ ID NO: 2199 - DNA, 400 bp; double-stranded, linear
ggcggttttatatttatcgttgcagttatgcaaattgtacttggtagaagtatagattctcgtgattcgaaaaaagtacttttaacgggattgggaatagtaatcatatctagctttatttgtgcagtgacacataactttatattatttgctatatcaaggttatttcaagcaattggttgcggaattattcctctcgtgactttaactttattagccaaactaagtacagataatggtagagctcaagctatggcgaactatcaaatatttttatcatgtgcaccagctttggcaccaatcttagggagtactttaggtggcaagatggggatatattggtattttagttttttggctcgttatatctatcggtattatttttggatanctntnttaa

SEQ ID NO: 2200 - DNA, 50 bp; double-stranded, linear
ggatatgcgatggatgacgcattgctatatcggcaattgngaagctgctg

SEQ ID NO: 2201 - DNA, 50 bp; double-stranded, linear
atcgaatatcactactatctctnttnaagtatctacaatctctccaatct

SEQ ID NO: 2202 - DNA, 400 bp; double-stranded, linear
tcgacaatcctaatgcaattgcttcatgtggntgtggtagttcatattagaactgcaaaagttgcaggtgatcctgaaaattgctaataaaataactttttaatggttaacccaatttttgggatacaaattgatatcaataacgattaaggacatatttgattatgtcctatttttgcgtaaagatattttgttttattaaaaagcttattgaaaattaagaatctgactataaatagtattttaaatgatcgtgatagcggatacatttttaatcgaaatcaggctacgaaaaaattaattaattttttcacaatctgactgaatcttgcttgaaaatataacataaaagctatagaattagtattggattaaaaatgtcttttttgtgaacatcaca

SEQ ID NO: 2203 - DNA, 400 bp; double-stranded, linear
gcgttgtccttttcgtgacatgaaacaatgtggaaaacataattaaatnnagggaaagtgtgaatagttaaaaaattagtattgtgttataaaaaataattaatactgttaggatttcattaactaacttaacgttggttcaaaaatagttaaaaagaggttaattcatagcgcagtatctcacttatataatgatagtagattgttcgtattacgtaattgaattaatcatataaaaatatattaagacaaatttataaatagattgggagantagtactgtgaaattaaaaacgttagctaaagcaacattggcattaggcttattaactactggtgtgattacatcagaaggccaagcagttcaagcaaaagaaaagcaagagggngtaccaccatt

SEQ ID NO: 2204 - DNA, 136 bp; double-stranded, linear
gttattttgtatggttagtctttaaaatanatatagatattaaatatttattttacgaattgttaagtaaagaaaaaatattaatcaatccgggttacatttatggcagtaaagaaaagagtataaggctatcttt

SEQ ID NO: 2205 - DNA, 400 bp; double-stranded, linear
ttttattttttcgcaatgaaaaacaatctttctgcatcttcattatgttcatctatattaaaatcagtaaatgtttcaacatgtttaaaaccaacttgagctaaccaagacaaatatgtcttttcatcaaatgttctctgaaaatgagactcatcaaatcttgaatatgtttcatcttcatgtcgaatgaaaaatgtcatatcatgataaacacttaaaggtaaatctccttgcacagcatcccatgctaaaaaaatgtcccctttatcatcaatataactttgattattaaacaaagtcatcattttataaacagtatgtacatcagaaataaatacacctgaatcagtcagatgatgataaacattgatgaatgtttcaatcactgcagtttcatctt

SEQ ID NO: 2206 - DNA, 379 bp; double-stranded, linear
ttgaatatcatataaaaacatcaggttcaaagttgactactcttaataatataaaaataagaattaaaaacattaaacgatactgctctgagaacttgcttttaaacaaacttgatacaaaatatatgcagatatttattaataaattatcagatatctattctcaaaatcaagtaacccgtcaactcggagatatgaaaggagcnattaaatatgcagttaaattttacaattatccaaatgaatatttgttaactaatgtcaaaattcctaaaagaaganaaacaatagaggatatcgaaaaagatgaatctaaaatggtaccactatttagaaatggaaccaagtcctacngatacgtgatcatatactaatggat

SEQ ID NO: 2207 - DNA, 137 bp; double-stranded, linear
catcttgggacgttttaaaaagtaacgtagcgaagactattggaacaacaatgagaaccaatgctagaaggatcaaaaagtattttaaaaatttattcatgattgatgctcctatattaaatttntgttaaatcata

SEQ ID NO: 2208 - DNA, 72 bp; double-stranded, linear
gcgccgctctgttcattttacctaaatccaacgtttcaggaatagatgttttcaaaccactttgaaatggat

SEQ ID NO: 2209 - DNA, 52 bp; double-stranded, linear
atgtagcaactaaagatgatagtggatagcgacacggtcaataaactgccta

SEQ ID NO: 2210 - DNA, 206 bp; double-stranded, linear
ttttttatgttcttttttaataagagggaagtgaagttgtataaaaatgtattaaatatgcactttttatacattaacgattcatatatgtctattatgtaccaaatttataatttgtataattttcgaactggttaaattcgaaaaatatcactaatatatntagatcgatgtgtaacattacgttctantaatttaatgttgca

SEQ ID NO: 2211 - DNA, 60 bp; double-stranded, linear
acgatgtattttgatatcgttaccaaagtcttttaataactcattttcatctaaataaat

SEQ ID NO: 2212 - DNA, 331 bp; double-stranded, linear
tgataaggtttgtcccatcgctatttgaaatgatgcattgtaaaaaactatcatttgttggtaatatcttagttcgatgactttctttccaatctttccgtgtcatagagacaagattttttgtagctatcttagttgcttcttgaatgttcatttgttattcctccttttaagatgtttgtntttctttaaatgctaaaataattgatttctttttatcattcgtgaatacgaaattttcgtattcattacctaaaaaaatatcatcatatttaacattaaaagcactcatatacttagaaagtaaactaacnttaatggntgtagagtc

SEQ ID NO: 2213 - DNA, 61 bp; double-stranded, linear
agcataaaccaaaagatgcggatatacttgaacgcgtcaaagatatacttaataaaaaaga

SEQ ID NO: 2214 - DNA, 56 bp; double-stranded, linear
tctatttgagtttacatttgattaaatgaatgacaattatatgaacctgacttggt

SEQ ID NO: 2215 - DNA, 400 bp; double-stranded, linear
ataccactactatacagttaaattaatatacgttaaaactttaatccgatacattggttaaaatgatgttcctcgctggtggatcgagacatacttcgctctgacttctttagtcagttttttttcagctttttaggtgtaatcactgactttgttacatcacgtcaaatttacagtcgctattatcttaacttatcnacgcttatcacacatcaattcagatattatattgcattggcgnctatcactttgaacctgctgtgactggaactactggctgtcangagcgagggctgataatgagcataaagcaacatataagtaatacggccgaatatgtaaattcggcagctttaggcaatgctgcccgggcatgactagnacattcacaagaagctca

SEQ ID NO: 2216 - DNA, 133 bp; double-stranded, linear
tttttaaaaaaggggttaaccaaagttttggaaccccaaaaaattccggagttaaaaaaaccccaaaaaattaaattaaccggttattccgttccaggagccaaatttttatggttccaattnccaaagtggg

SEQ ID NO: 2217 - DNA, 64 bp; double-stranded, linear
tactcgtaccattaaccagtctgattaaccacaatactaaggtattcaatacatcactgacatc

SEQ ID NO: 2218 - DNA, 82 bp; double-stranded, linear
tattctatagaatatggataacgtttaacatgatgtagagtattcatcattgtaacacgtcaatttgatatgtgagattaac

SEQ ID NO: 2219 - DNA, 70 bp; double-stranded, linear
tttgacgcaatgatttagctgtaaatatgcaatctaaaggaaagtaccacttatgagatgtattaaaacg

SEQ ID NO: 2220 - DNA, 66 bp; double-stranded, linear
aaaaattaccccaaagaattgaaaatttgttgtttgggttaccgggtttaagattaatccggttga

SEQ ID NO: 2221 - DNA, 54 bp; double-stranded, linear
gatcgcaaccaaaataatggtcttcctggattattactttaccagctggcatac

SEQ ID NO: 2222 - DNA, 50 bp; double-stranded, linear
gtgttgctacagctancatttcatatttaacgngttgtggtatttctaaa

SEQ ID NO: 2223 - DNA, 50 bp; double-stranded, linear
aatgggggnacccagcntgagttatgtcatcatatcggtatgtgatacat

SEQ ID NO: 2224 - DNA, 54 bp; double-stranded, linear
gtagatgcgccctcatatggacaaagataaagtatcagcagattggacgcttta

SEQ ID NO: 2225 - DNA, 63 bp; double-stranded, linear
cgagacttcactttgactaaacgcgttaagaatttagattatgcttacgatgaagaagaatta

SEQ ID NO: 2226 - DNA, 55 bp; double-stranded, linear
tggccatttttaatggggggaaaccttaaaaaggggtttttaattttaaaccaag

SEQ ID NO: 2227 - DNA, 131 bp; double-stranded, linear
tccatttggttgccttctttaaataaaccttggattatgcctttcctccggttaattaatgggaccaggggccaaaaatacccccttttaaatatanattcccaaaatccatagttaaataatccatttgc

SEQ ID NO: 2228 - DNA, 350 bp; double-stranded, linear
ccatctgtgcttcgttaggcgctttcggcatcacggtgatggtttgcgacagatccgccatccggctgaatgggaagcccgcgttanaaaggcgcgtagatccggcatcgggatgaagtggtaatacttcgagaagtcgatggtggagtcgtcaccaatcaccacatgattctgcaccggctggaaggtaatacagttatccaccgaaccgcccggcatcgggttcatatactcaaagtcgaagcgcactggntttggtcgcgcccagtttcagcgccggaatagagacatctgttttgccatccagcaaaccttgtaataccggantccgcagcagcaggcggtttcgc

SEQ ID NO: 2229 - DNA, 58 bp; double-stranded, linear
aactaaaaatactatataaaaaaggttgttataatttaatggatataaataaaaacga

SEQ ID NO: 2230 - DNA, 50 bp; double-stranded, linear
gggcgaaagctggacggagccaacgtcgcgtgagtggatggaaggttctt

SEQ ID NO: 2231 - DNA, 50 bp; double-stranded, linear
agccatacgtggtaagcacatgctaaatttgccagcctgaaaatgtttag

SEQ ID NO: 2232 - DNA, 132 bp; double-stranded, linear
tgtatcattttggcaaaatcataatctttatcgtcgaatacaactacttttaagtttaatgatgaaggtacgcattgtgtaatcacttcatctaacttttttaaatcaggtgtcatagttgaacttggnggt

SEQ ID NO: 2233 - DNA, 78 bp; double-stranded, linear
gatcttgaagcagttgaaacatatgtatcagatgcattaagacaagtacacttacaatcagacatttttgctgtatca

SEQ ID NO: 2234 - DNA, 50 bp; double-stranded, linear
tttaggcacagacggtaataagctacaattttcataaaatcatctccttn

SEQ ID NO: 2235 - DNA, 54 bp; double-stranded, linear
atcctggaaaatctggtaagatatcttggaaataactaataccaattcctaaaa

SEQ ID NO: 2236 - DNA, 54 bp; double-stranded, linear
gggtgatggtcattgacaaagtcaacttgtgataagccatggatatttttcgtt

SEQ ID NO: 2237 - DNA, 50 bp; double-stranded, linear
ttatttactttaaatttctcaatctacagtgtaatcttatttcttattat

SEQ ID NO: 2238 - DNA, 74 bp; double-stranded, linear
ccttaatgggttttgggggggggcccccccggcccaaaacctttggcccaattggttcctgggttaaggaaaaa

SEQ ID NO: 2239 - DNA, 71 bp; double-stranded, linear
ccacccatggcgcttgacaaaatatggatggaacataaccacaccgtccaagttcactgttagcaccgtgt

SEQ ID NO: 2240 - DNA, 64 bp; double-stranded, linear
cagctaggtagttagggattcgactcgtaaaacggattaataggttttataagaagggggtttg

SEQ ID NO: 2241 - DNA, 58 bp; double-stranded, linear
cttgacacgtacatctaatacgacagtctgtgcgtttaaaaccttttgggtcaaactg

SEQ ID NO: 2242 - DNA, 50 bp; double-stranded, linear
gactcatcaccgnttgttaaganatacaatttattacccagcanttaaca

SEQ ID NO: 2243 - DNA, 71 bp; double-stranded, linear
aaatttggattggttggaaatttacagttaaaatttaaagggtggatggaaaaattttaggaacttctaag

SEQ ID NO: 2244 - DNA, 50 bp; double-stranded, linear
gggggccccttgggggtttgggttttggggggccccccttttaaaaantt

SEQ ID NO: 2245 - DNA, 52 bp; double-stranded, linear
ttataatttttgaaaatagaagagggaagccttaaattaccaaatggattta

SEQ ID NO: 2246 - DNA, 55 bp; double-stranded, linear
attagttgaaaagtacaatattccgcaagttaccaatcgatacaggtattacaag

SEQ ID NO: 2247 - DNA, 50 bp; double-stranded, linear
aantcgatgctttgggtagtggagccctgttgccttatatctattacttc

SEQ ID NO: 2248 - DNA, 107 bp; double-stranded, linear
gggaaggtaaaacttcctgctttttttataagtattcatactctattgctatattagtagaaaccgtaaaatcagtcattcacatacattntgaaacatctaaatag

SEQ ID NO: 2249 - DNA, 168 bp; double-stranded, linear
gttggatacctgnaactaaataactattctttaaaagttaaaaaccaaccactagtggccattggggattaaaattccaacctgggccggtccatccccatggtgggtaaaatgggggagggaaaatccttattagccaaaggattccttacctaataatagggggaa

SEQ ID NO: 2250 - DNA, 50 bp; double-stranded, linear
tttagttgtgacatactgagaactgtagtacttagtgcnataccaaaggg

SEQ ID NO: 2251 - DNA, 59 bp; double-stranded, linear
gcagaacataccacgtgtcgctgattaccaatacagtagatcaagatggactcgattgc

SEQ ID NO: 2252 - DNA, 52 bp; double-stranded, linear
gtttgtgttttaattttaaggggaagggatttttttaccaaatgggaatttt

SEQ ID NO: 2253 - DNA, 80 bp; double-stranded, linear
agtgtaattagaaaggcaagtacacctgtttaaagtttatcttctaagatttgtttactttagaactatagcagttaatc

SEQ ID NO: 2254 - DNA, 66 bp; double-stranded, linear
gtaaatgacagaggaaatataacaatgattaataatgttacagcatttactgcaaatatctactat

SEQ ID NO: 2255 - DNA, 50 bp; double-stranded, linear
acatgtgttaactctttggcaatatatcctgtttcttcttctaattcacg

SEQ ID NO: 2256 - DNA, 69 bp; double-stranded, linear
aatcttttataggaaagaaagaagaagatgttatcagttgcgattatcggcccaggcgctgtcggtaca

SEQ ID NO: 2257 - DNA, 64 bp; double-stranded, linear
tagcgggagatagaaaaaccattccgcattagctttggtcaagttgggaatgggtaaaaaaata

SEQ ID NO: 2258 - DNA, 106 bp; double-stranded, linear
ggttaaggtatggcgaaatatctccaacaacacttcaaaaggttcaagaaaatagaagtcgactgaacaatgtcattcacatgtgtgcgtcatgcacaccntatgt

SEQ ID NO: 2259 - DNA, 79 bp; double-stranded, linear
cggaataactgactatgtatcatttgatgttattaacatcaatatttttggttaaatgatatgctagaaataaagcata

SEQ ID NO: 2260 - DNA, 50 bp; double-stranded, linear
gctggntgttantggcagagcatgtgagctggataatcagttggagaggc

SEQ ID NO: 2261 - DNA, 50 bp; double-stranded, linear
nccattaatgaccgagattagtgagcatgcacaaattgttatggtaggat

SEQ ID NO: 2262 - DNA, 51 bp; double-stranded, linear
aatgaaccacataatgacaacttgaatgacaatatgaatatgatgtcaaca

SEQ ID NO: 2263 - DNA, 55 bp; double-stranded, linear
cattaggtgcttatataaattactttgtggtggctccaaaacttcgggttaaaac

SEQ ID NO: 2264 - DNA, 50 bp; double-stranded, linear
tttcntcccccccccggggttttttggtccctttttttttttaaatttcc

SEQ ID NO: 2265 - DNA, 52 bp; double-stranded, linear
tcattcatagaggtgtaaagacataaggggagcttaactgcgaggacctaca

SEQ ID NO: 2266 - DNA, 55 bp; double-stranded, linear
agatgatgcaataatggtgcagtatagaagtactgagcaatgcaaattttagacg

SEQ ID NO: 2267 - DNA, 51 bp; double-stranded, linear
gttcatcacatttattacattcagcgttggaatcagtactgggttatcatg

SEQ ID NO: 2268 - DNA, 54 bp; double-stranded, linear
ctgttgacaacaaattaaaaatgacaacatgtcgtagttatagttaattgattg

SEQ ID NO: 2269 - DNA, 312 bp; double-stranded, linear
aaccaaaaagaaagcaaggtcaaggaaatttcagcgngacgtatctttagttttgaataagcatattaatatggtgataatatgcaaganaacctgtttattcgattcaatgaaattatattattaatatacttaatcagtatcatttgctatttttatgattttgtacaaaaaagtcataagattagaagtttaggcatatatttattggggattgtttgggttttacaaacaatctctttatctatttttattatacaaactagacatattccattagggnctatttcagatgtattctatactttaagt

SEQ ID NO: 2270 - DNA, 58 bp; double-stranded, linear
gttgatggattctcttggtttggtgtagtcacaatttctgaactggcccttgtttacg

SEQ ID NO: 2271 - DNA, 50 bp; double-stranded, linear
cgttcagacgctaaatcaggcaccaggttgtacaattgtcctggttcttc

SEQ ID NO: 2272 - DNA, 58 bp; double-stranded, linear
caggtgttggtaaaacatttgagatgctttcaaatgccattgaactatttcaaagtaa

SEQ ID NO: 2273 - DNA, 400 bp; double-stranded, linear
ttataaattggtgtaacaatttcatacacatgatcattctttgattgaggtaaaaatgattctactaaacgtacacgtttatgcttcttatattctttcatcaataaatatctatgattagctaatgataaatttagtagaagcttgttatctccataaactaaattcacgatattaggtatattgaattgttcttgatatttcaaaaattgttgatcccattcttcatttttaggtaaaggtaataccatctcgttaattttccaatatgctggtttaagaatgacatttttatatctgattcgtggtgaataactaaatgaatcaatactcacatcattcataggttcaatgcatttcacagattccattgaaatttctcgtaacaatcgatatnaat

SEQ ID NO: 2274 - DNA, 50 bp; double-stranded, linear
gggtacaaatttgtngatgatagaaaagttcgtatcgctagaaagtctgg

SEQ ID NO: 2275 - DNA, 65 bp; double-stranded, linear
tgatttaccagttgattacgacaaagaagaattttcaagaattgttgaagcatcaaaacgcatta

SEQ ID NO: 2276 - DNA, 55 bp; double-stranded, linear
atggcgttccaccagcagtcaataatcctgttgggataaatgccaatactgtcga

SEQ ID NO: 2277 - DNA, 76 bp; double-stranded, linear
taataaatcacgtgcatttacgctcactagctttcatctcctcatttttgcttttcaaatttattaagtatgaata

SEQ ID NO: 2278 - DNA, 65 bp; double-stranded, linear
gtggctttgtctgtgttattgtagttttgtttcgctgcgtccagctttgctgcttttcccgtatg

SEQ ID NO: 2279 - DNA, 69 bp; double-stranded, linear
ttaagtgccaaagtccttggtagccagaatgaaccaccaacctccatttttccaaaaatggtcttacct

SEQ ID NO: 2280 - DNA, 67 bp; double-stranded, linear
ggatggaattgggttaagaataaaaaaggtaataattgagtttatgataataataataatattgaga

SEQ ID NO: 2281 - DNA, 76 bp; double-stranded, linear
ttgttacttcggcacggataaatccacgttcaaaatcagtatgaatgataccagcacattgaggtgcagtcatacc

SEQ ID NO: 2282 - DNA, 137 bp; double-stranded, linear
aacccagaagacttattattagaatcttaatccacaacacaaaatagtttactattcctaaaagcgggattaaatcaataacaaacagcagtaagattatttcctagtcgaaatatcttactgctgtactttatttn

SEQ ID NO: 2283 - DNA, 52 bp; double-stranded, linear
acaaagatttactatttaactaatttatatgaagaatagctttccctaataa

SEQ ID NO: 2284 - DNA, 51 bp; double-stranded, linear
actcctgcatatcacaactagattaaatatacatcaaacagatatagtaaa

SEQ ID NO: 2285 - DNA, 77 bp; double-stranded, linear
ctaacatgtgtgaacgatatgcaaattcaatatctcattcacgctttgcactttattactacaatcaacgtaactat

SEQ ID NO: 2286 - DNA, 58 bp; double-stranded, linear
aaacctgtatttttaataaacaatcgcttggacctattcactgcagctcttctgggac

SEQ ID NO: 2287 - DNA, 204 bp; double-stranded, linear
aattcataaaaccaataaataagaattttatagtaaaaggaaatggantagagttggcagacttatacaatattaaaaacaaagagcttttcacgattaaaagaggaattaatacatctttatctctttatagtctagaacaggaatataataacaattaacgccttaaaatatccagaatcatataattttgaagaattaata

SEQ ID NO: 2288 - DNA, 50 bp; double-stranded, linear
gctcgtaaggcgtcaactgtggccttgggtgctacatgtaaaggttactt

SEQ ID NO: 2289 - DNA, 53 bp; double-stranded, linear
tcgcttcggtggtaaaaatgtcgtggaggtcccgttgcagatggttttaaacg

SEQ ID NO: 2290 - DNA, 68 bp; double-stranded, linear
ttggaggtcaatgttcggcgtaatcttcaatgtttccgtacacaattgctgcggttgacacacatacg

SEQ ID NO: 2291 - DNA, 53 bp; double-stranded, linear
ttcgacgaattaaaacaaatccttttatatgttgaagtgtattcgagattaaa

SEQ ID NO: 2292 - DNA, 63 bp; double-stranded, linear
atcaattgtcaacatctaatattcactaccaattatatcgccacatgttttttagcagtaaca

SEQ ID NO: 2293 - DNA, 55 bp; double-stranded, linear
cgactcaggtccatcaagagagacacatttcgactacaggttattacttctttga

SEQ ID NO: 2294 - DNA, 61 bp; double-stranded, linear
aaattttggttaattttaaaaccaaaaaaccttggaaggaaatggcccttttcccaatttt

SEQ ID NO: 2295 - DNA, 158 bp; double-stranded, linear
aatcttaaaacctatggcgtctattacattcccaaaacctattttcagnaatgttaccaattaaacttgccggggtatggaccagggtaccaggctaaaaactggaagaaaggaaggaattttagaaaataatttattaacatggaccaggtaactaa

SEQ ID NO: 2296 - DNA, 68 bp; double-stranded, linear
tgttccaacgatgaatgtttgcatgctttgttgcactgaaattgatgagttgctacttgcaatcctag

SEQ ID NO: 2297 - DNA, 72 bp; double-stranded, linear
gtagggattttttttaaccgggatagcccaaccaaaatttaattaattttgggtttttggattgaaggaatt

SEQ ID NO: 2298 - DNA, 213 bp; double-stranded, linear
aaaaattntaccaggtgaaaaattattttggtaggatttaaatntaatggtttaaatggtggtttattacctaatttaaaaatggttaaaagggcctttaccatttttaaaatttaatccgccttttgggagggggattttagggatggtccagttaggaccccattaccactggaaaccaacttaaaatttgaccaaatttcctggaaaaaa

SEQ ID NO: 2299 - DNA, 159 bp; double-stranded, linear
tatttttaaaggagggtaataatcttaatttaagttcattatttttactttcattataaatatttaatgttactttcttatttagataacaataaaaaaatataatctctnaaaacccaatgaaacagctgctccaaacaattagttcttctaattgaa

SEQ ID NO: 2300 - DNA, 65 bp; double-stranded, linear
acaaggtcattcggatttgactttgtttcaattgttaaattttgctccatcaattgtctaattct

SEQ ID NO: 2301 - DNA, 50 bp; double-stranded, linear
tttattcttatttaaaaacccantgaaagtantctttncattantaaaaa

SEQ ID NO: 2302 - DNA, 62 bp; double-stranded, linear
gagatatatgcatgagctctacgacttctttaggtttcatggcgactatcctggcagggatg

SEQ ID NO: 2303 - DNA, 56 bp; double-stranded, linear
accaatcccgttgttttggttttttaaaaaaaggaaattccaaaaatcccccattt

SEQ ID NO: 2304 - DNA, 53 bp; double-stranded, linear
tttaaaacccaacgggtttggttaaaatggcctgggcttttccaaaacttggc

SEQ ID NO: 2305 - DNA, 60 bp; double-stranded, linear
cgaacaggttgccactgtaagatctggtggcatttaatggcaatcgtattttatttggag

SEQ ID NO: 2306 - DNA, 74 bp; double-stranded, linear
ctttataatggcggcgcacttggcatctctgcattcagttacacgcggtggcaacacaaaatttagggaattct

SEQ ID NO: 2307 - DNA, 53 bp; double-stranded, linear
tgtccatgcacagctttattggaatttacctttttacaggcaaccgctaaaga

SEQ ID NO: 2308 - DNA, 76 bp; double-stranded, linear
taaatgattatgggaatatccaaaattatcgagatctaatatgaagtgactgcacacatatcagctctgaatgaat

SEQ ID NO: 2309 - DNA, 117 bp; double-stranded, linear
tcctcaaaatgtgagttaatagtcgagtggaagctgtgacttgagcgacgatacatcatcanactatcaataatgtttgcacatcacttttactactatcatttgatgtataaatac

SEQ ID NO: 2310 - DNA, 52 bp; double-stranded, linear
aaactcatatcgcttccgataaccaaccctgctgctgttggtacaaattgtc

SEQ ID NO: 2311 - DNA, 56 bp; double-stranded, linear
aacactggagtcctaatgtcatcaaacatctacctataagaccttatataatcgtc

SEQ ID NO: 2312 - DNA, 72 bp; double-stranded, linear
gataacatcataggccataacttccatttaggccatcagttatagcatgcggacgacatactgtgccatatg

SEQ ID NO: 2313 - DNA, 52 bp; double-stranded, linear
catctaatgggaacgtgtcgatcctagtcagtatagtcatcggcaggtacga

SEQ ID NO: 2314 - DNA, 64 bp; double-stranded, linear
taaactgaaatttaattttcggatggtattgttattaagaaatagacataatttgtgctggata

SEQ ID NO: 2315 - DNA, 59 bp; double-stranded, linear
ctagtttaaatttcttaaacttctacatcagtaaaaggccgctctgggaccatacaatc

SEQ ID NO: 2316 - DNA, 54 bp; double-stranded, linear
gcatagtaacttaattgataggagatgaaaatccgcaaagtcattggaaggatt

SEQ ID NO: 2317 - DNA, 150 bp; double-stranded, linear
gtatatgctggaaagataaagtatgganaatgcatggcgaacattttgtaagcagaatgagctataagcgttgaatgggtttgaacgtaaacaatcgaacaatgatatgtcagacatacttgctttagagcacatttagagagcgacatg

SEQ ID NO: 2318 - DNA, 52 bp; double-stranded, linear
aaatcatcgatgttaaataatttaatgacaaggattaatgaaagacggattg

SEQ ID NO: 2319 - DNA, 52 bp; double-stranded, linear
ttaaggaaaccttggccaaggttaaggaaaaccgggggttccaaggttttta

SEQ ID NO: 2320 - DNA, 50 bp; double-stranded, linear
atgaagttgatttaggatgaaaattaatcttgggatatttaatactttgt

SEQ ID NO: 2321 - DNA, 50 bp; double-stranded, linear
ctaacgctaagggcgacggatggtggtnatgtcaaagagacaaataggat

SEQ ID NO: 2322 - DNA, 108 bp; double-stranded, linear
cgtggtgattaatttttcgtcgcgttttgtttcctttccccagtcatgttttatcattgtgggcatcattgcacctgggttccatattatgacgtcattttttanaat

SEQ ID NO: 2323 - DNA, 212 bp; double-stranded, linear
gtcaccgaatttcgatttatattatcactcaatttattatcttgaagcacgcgttaaatcgtctttaaattgnaacagttgctactttattgtctttaccattgatctgaatttgatccgctttaagtccactatcttttacaacttgcnctaccttttgttgagtaattgcttgtttagattggaaatctacgcgtgtaccacttgaaaaa

SEQ ID NO: 2324 - DNA, 133 bp; double-stranded, linear
tcatttgtttttaatacgttgtcaaaattaccaacaaatgacaaattaaattttgcaatacatatcaaggtgttatttttttcctattttaattatgtataacgcattaaaagtgacgtnaatattcaaagga

SEQ ID NO: 2325 - DNA, 216 bp; double-stranded, linear
atgaacgaccgtggacagacaatatttaaagcatttaaaaacagcgttcccagaaagacaatatataaccaatattaacaaaagcaatgcacattacttcacaaatgaaatcaaagcaacacacatatacaatgcaataagcgggcaacaacaaacagatttcaacacgcctgtcatacagcaatatcgttaacaaatgacanccgccntttaggc

SEQ ID NO: 2326 - DNA, 141 bp; double-stranded, linear
tgaccatatgattgaggaaggttttattgatcctaagtatcgtgctcttgcaccgttatgcgacactaaggaatcattaattgaatcaatattaaatttnaaacctctgggtactcgttcatacgattaatcattctaagg

SEQ ID NO: 2327 - DNA, 55 bp; double-stranded, linear
tgaaactgcagcgtggccgagtgggggttgtgccaggtgaccccagatgggcgtg

SEQ ID NO: 2328 - DNA, 54 bp; double-stranded, linear
gaagccagcctaattggataccaccggaagtaacttttgaccagggccgtcgca

SEQ ID NO: 2329 - DNA, 54 bp; double-stranded, linear
gttcccgggtccaggccgttgtcttgtgccggggtgtttggtccttggttgtgt

SEQ ID NO: 2330 - DNA, 190 bp; double-stranded, linear
tatattatatatttaactgctgtgatgtattctgaaaaaatagtagtattgcctataatcatctatgccattgtgtttgtaataattggtatcacttatatctttataggcgacagctatgatcaattaacaaatttcaatgtgattttgtatatggggagtttgtnttatgcatggatggctattagaa

SEQ ID NO: 2331 - DNA, 54 bp; double-stranded, linear
ttttcacctcgtgttttaaattcaattgaatctaaactaaaagtacctttaagt

SEQ ID NO: 2332 - DNA, 246 bp; double-stranded, linear
ttctaaaaatattaacgaattatacaactttaagagtttttagtatgtaaatattcttttcatattaatacaatacacccctatatatgctcacttgtttgaattaataaactttagcattctgcaaataatattttaaaaataactatactttttatttacctattgaaaaatagtgttatcatatttattaagaagctatttttatactagtaggtgtcagtcatgaataacattttgttaaat

SEQ ID NO: 2333 - DNA, 52 bp; double-stranded, linear
ccttctaacatctttttaccactcattgaaacatgtgatcctaataacataa

SEQ ID NO: 2334 - DNA, 60 bp; double-stranded, linear
agaaaagagactgaaacaacaaattcaggcaacttttgaacaacagagacatcgattaat

SEQ ID NO: 2335 - DNA, 193 bp; double-stranded, linear
cctcaatcagctcctaaagaacaaaatagcgactcgattgatgaggaaacagtaacgaaaaaagaacgaaaaagtaaagtaacacaattaaagccattaacacttgaagaaaagcggaagttaagacgtaagcgacaaaagcgaatccaatacagtgttattacaatnttggtattgttgattgctgttatat

SEQ ID NO: 2336 - DNA, 58 bp; double-stranded, linear
cctacagtcccaacactgtcagtacactgccgatacccaacctctggccggtccggca

SEQ ID NO: 2337 - DNA, 50 bp; double-stranded, linear
atatttttnatttaatggttttactactgctacaactatcataggtggca

SEQ ID NO: 2338 - DNA, 378 bp; double-stranded, linear
ctcctgtagatttaaaatctcctaaataacaaacgaataatcggccatctttatgtattttgattgctgcaggattcgctttgtgacttacaaaaggtcgtttgatttccttcgtttcaggattgattttgaaaatattgccttcgaatacatccaataaaaagagttgtccctgccgatcaaagttcaatccttctagttgcaatccttttttggaaatttcaagccatggttcagctgtaattgtttgtaattcactttcagatataattggaacagcactattggacttcccgcnataaaataatggagggnaaanctggtggggacatccatgagccattcctttccattccattcggttttaactaaccaatt

SEQ ID NO: 2339 - DNA, 50 bp; double-stranded, linear
atgaaaataaactgtgtctccngatgtatacgtcccttcaagcagacttc

SEQ ID NO: 2340 - DNA, 59 bp; double-stranded, linear
tatccatatgtgaaaaatgtcatatatgagtctagttttgtataaatggagactcgaac

SEQ ID NO: 2341 - DNA, 189 bp; double-stranded, linear
attgataaaatatgattaagcgttgttgcaaatgacattttctcaaaaagcgcttcactatcaattggtacttgtgtgtnaatttcagccagtcgcttcgataaatatagttcatctaaattgtcattaatcttattacgttgcccagctgataatgcatcaatgttttcaaccacattttcaacgctt

SEQ ID NO: 2342 - DNA, 165 bp; double-stranded, linear
atcaattaaaacaaagcatacaacaatttgttgatgttgaatctaaatcaattttagaacaacaaatgattcatcagcttcaacaaatggatcgttcttatgtagagatgattacagaatttgaaacaaataaagctgatatttcacgtcgccaaccaagggtna

SEQ ID NO: 2343 - DNA, 55 bp; double-stranded, linear
cttaaccccccttttttcccaattttaatggggaaaaattgtaattaacctgggc

SEQ ID NO: 2344 - DNA, 50 bp; double-stranded, linear
gacaaataaacatgacctggacaaagaagaacaataaacaagcctggcaa

SEQ ID NO: 2345 - DNA, 111 bp; double-stranded, linear
gtattgcgatgatgcatacgggtattgttctgattaaataatatttcatatttaatgttgataaatgttgaataaacaatccgcaaagngcacttgatgatagtgctaaga

SEQ ID NO: 2346 - DNA, 51 bp; double-stranded, linear
gcaaacagtttccgtgtccgttttccaattaagttaaggaacccaaagaga

SEQ ID NO: 2347 - DNA, 60 bp; double-stranded, linear
tcgtaggtgccataacacacgttacctgggactcatatgaagtattatgtcgagacgacc

SEQ ID NO: 2348 - DNA, 118 bp; double-stranded, linear
gtttttaataggctctttacgtatctaaaaataattgcattattggtgtgccttgatgtaattgaattaaagtaccgtttggttgtaacgtttcaggtatatcattttcaacnataac

SEQ ID NO: 2349 - DNA, 176 bp; double-stranded, linear
atgacagaaagcaaaatcccaatgttgatataccgtttttgacaccacttgattatcattattttttctttagcgatggattttatattacgatttcaattcttactatcgttgcattattgtcattcaaactgtatcgtttttactnttatagacttttcgcaatagtaacatgg

SEQ ID NO: 2350 - DNA, 201 bp; double-stranded, linear
tcacagcacagcgattaaatgatgcagtaaaaccaaatcgtttcatgcactttaacataactacgactgacattaactgtgcagatgtacctggattctattttttcaagaacaaattgtaataattgatagttatatggtgcaatgtcaccttcatccattgagcgctcaataatttcagctgcnagagcggcntgactg

SEQ ID NO: 2351 - DNA, 158 bp; double-stranded, linear
atcgctataacctatcagtgataatatttgattgcatggtgcaccatttganatttcacttagaatggtggtacctaattgcttatttttatatgtcatttgaagatttaaaaattaaaaactttgatacagagtgaaaccatatttcaacaaattac

SEQ ID NO: 2352 - DNA, 400 bp; double-stranded, linear
tcgtaatcaaaacattttgaacaggattatagtaagggaatttttggattttaacttgtgtttgttcattttttaataagagtcgagctaagtcttgcaacatcattacttgcttggcatctaactgttcgtcattaaattttatgaaacgatcactcatgttttatccctctttaaaagtttagttctacagcattatatattgcttgttgttcacgttcatcttccaatttatcaataattgtacgtttaattgcacgttcaactggcattacagtgattaaatcacacaagtctaataatgcacgggatactagcggcttcttcagaaatttgtccctgcttagacatagtacgtaaatcttcattgaaacttnaataatttggttcgatttggttt

SEQ ID NO: 2353 - DNA, 127 bp; double-stranded, linear
attaatggggttaaataacattttgactgcgaaagatttattcttttcaggtaaatcattgatagatgtatatagtcaatttgctggattagctgaaatgataaatgtntttgcgaatgcaccattt

SEQ ID NO: 2354 - DNA, 223 bp; double-stranded, linear
atctcgctgtttttatgaaagaaaactacattttcgagagaataaaaagatttttctgaaatttaatctatcaattacattgatttactaatataattagaaagtaaattttatttgatcaaagtaaatgggggaagtactgtgatagaaaataagaaaacagttgaagatacatattcaacaggcgcaattgttgattcaatatcatcttcagtncaaatgn

SEQ ID NO: 2355 - DNA, 400 bp; double-stranded, linear
acacttgttcaaacactcacaatgataaagcatattatcagtattgtagtgtgtggaaaatgacagccatctaaggagaaaaatgatgaaaagaatattggtagtatttttaatgttagcaattatattggcaggttgttctaataaaggtgaaaagtatcaaaaagatattgataaagtgtacaaagaacagaatcaaatgaataaaattgcctcgaaagtacaaaacactattaaaacagacattaaacaagaagacagtaatacacatgtttataaagatggtaaagtcattgttattggtattcaattatataaagntcgtgaaaaaatgtatttatttcgcatatgaantaaaaggtggttaaggccagaggatttaatcagnggaaantagacc

SEQ ID NO: 2356 - DNA, 344 bp; double-stranded, linear
aatttactttgtgccacaaggttatcaatgtcttttgaaccaccaaacattctagcgattaagtgacctccatcatcgtctggtaatctatcctctccccccacagttctttgtgcatggctattacgatccccatcttttagagagagattgtctacataaacttcttttatgcgacctttatgatcggttcgatatatgtgaccagtaggtgttgtgtattcaatattcgcctttagtttcttaggtnctaagtcttggcatagtgttctccgaattcnaaccttggtgttagtttggtgattcaacatacttttgatggaattcatttncatgggctactt

SEQ ID NO: 2357 - DNA, 53 bp; double-stranded, linear
tatgcgcccctgcttgatctttcatttgcgtccactcaattagttgtttgcgc

SEQ ID NO: 2358 - DNA, 400 bp; double-stranded, linear
attttttcaccttctgaaattgataaatctaggttatcgaatatagtcttatcggcataagatttatttaaatgttcaattttatatgcttccatacccatcttccttcttctgttgaaatctctacgtacttaaatcagttctatacattatacacctttttgaaatcaaaagaaatcgataccgttaagtgtcataatttaatatattgttgcttcaactataaataaaacttgttaaggctttgatgactatgctaatgatctttataatatacctttttatcaacacatataatgtaaaacataatatanaagaacataataaaaacccggattgatattttatcaatccgagttcgtgtttagatattattttttagagtttgctttaggtcctg

SEQ ID NO: 2359 - DNA, 154 bp; double-stranded, linear
ttaatgtcgccattttttgttaggtagacgtataaatctggaccttttgatgatttgtagttagtaagcattaatttaccatttttaatctcagctttaccttcaacagtttcaccgtttttagaactgantgtacctgttaggtgttttgttt

SEQ ID NO: 2360 - DNA, 57 bp; double-stranded, linear
atatgtcttgtgatttttcaggtgtaagttagtatgcaagtgattatgattgatagt

SEQ ID NO: 2361 - DNA, 58 bp; double-stranded, linear
ggcatcaaattagtagcgactcacacgtgatgcatcctgtgttttggatctcatttct

SEQ ID NO: 2362 - DNA, 50 bp; double-stranded, linear
tgttattatcgnagaggcttttcgctttggaataaggtattacgtgaatg

SEQ ID NO: 2363 - DNA, 50 bp; double-stranded, linear
ctcttctggtccctgacatacataggagaaatagcnccatgtacaacgtg

SEQ ID NO: 2364 - DNA, 50 bp; double-stranded, linear
attgccaatgtcgttagttcgtgaggctgttggtgaaagttgtgtttgaa

SEQ ID NO: 2365 - DNA, 111 bp; double-stranded, linear
ccatgatttaaatcattgattaatggtgcttgttctacatctgtgtaaaattcatacaattctttagcatcgtcgaatagttcatcacgacgttggntaaattcttcttct

SEQ ID NO: 2366 - DNA, 139 bp; double-stranded, linear
taatgctgagcgtgttactttagttggatcaacgataccttcttctaacatattaacccactcntttgtagcagcgttaaaaccaacacccggctctgcgtttttcaaacgttctacaataacagaaccttctaatcct

SEQ ID NO: 2367 - DNA, 50 bp; double-stranded, linear
cctgattgcaaagtacagcaagcactacagacgcctaancactnacacta

SEQ ID NO: 2368 - DNA, 55 bp; double-stranded, linear
aaaatggtattgcaattagtaatgttacaacaagtgttgtaatagctgcataaat

SEQ ID NO: 2369 - DNA, 51 bp; double-stranded, linear
tataggatgaaaatcctgccaaaagattaaggggtggcctaatgaaccatg

SEQ ID NO: 2370 - DNA, 52 bp; double-stranded, linear
ttgctcgaggtggtaaatacgcaaagtttatttggttgtgctaagagagaaa

SEQ ID NO: 2371 - DNA, 66 bp; double-stranded, linear
taatttgaataaggtggaagtgataaacagtgctttgcgaatctagagtcattaatcaaaacccta

SEQ ID NO: 2372 - DNA, 65 bp; double-stranded, linear
agacaggtactgtcctacggtatggagcagaagcgggaaagctgcccagagccaactgtagacaa

SEQ ID NO: 2373 - DNA, 400 bp; double-stranded, linear
ttgcagtgacggcttataatcattccaagcgaacaattagacattccatataaaatatacagatggctttcagtagagtagtggattcggattcacgaactatactggaagctttttattataaatgaagagaagttatatttttagcatgtatagttgaatactgggttaaaataccatattaataatgaagtaaaggtatgagtgattatgaaagtgttttgaatgaaatatatttaattggtgatgcttttaattgaaaagattaacaggattcaacttggtaaattgtattaaatgtgagaaaataaaagtatattcattgagagatatatgagtcaatgatcgttttaaacaagataagtgtattttaatatgtaaaagttatgtaataaatatt

SEQ ID NO: 2374 - DNA, 70 bp; double-stranded, linear
cctatcatgcctctctctcactgaatcctttagatccccttccctccctctcccccctcttttcccctcc

SEQ ID NO: 2375 - DNA, 50 bp; double-stranded, linear
ccaagtcagagcagcagttcagttcgtcagcngttcagttcagagcngtc

SEQ ID NO: 2376 - DNA, 50 bp; double-stranded, linear
gttggtgaagctgttgccganggagaagcgggtatggatcctgacggtgn

SEQ ID NO: 2377 - DNA, 59 bp; double-stranded, linear
aattgcaggacaggtcaaaggcaaatgcacgtattcaggtcatgctcatgtgcatgttg

SEQ ID NO: 2378 - DNA, 229 bp; double-stranded, linear
tttatcatcgtataaatctatatctaattgattaaacttcgggtgcttaactaactctctcaatacacttacaccagcagttcccatgcctattattgctacacgcatatatcatccatccttttgtaattcaaaatattatatttaaactattacctataattatagcaatttggtatttccaataaaatttatnaaggtaagcnattatttcactttcacaaccatt

SEQ ID NO: 2379 - DNA, 116 bp; double-stranded, linear
agttttttgtttgacgtatttaatttactatttgcttgattgatatttttagacattaaatagtgttctcctaatcaatttattcttctttatntcagcattattcgcactgacat

SEQ ID NO: 2380 - DNA, 136 bp; double-stranded, linear
caaatcttagcggatgattggcatgtatattctgctggtatcgaancacgcggtgttaatcccaaagcgatagaagctatgaacagaagtcggcgttgatatgtcgaatcgtacgtcagatttaatcgataataat

SEQ ID NO: 2381 - DNA, 400 bp; double-stranded, linear
catcttcgtcagctcgatgggcatttgctaaggtaataccatgtgcctctgctaattcacttaattgatagcttttatctgtaggaaaagctattttaaagatttctagtgtatctataacttttttgggacgatattgaatattacaatctttaaatgcctttttaataaaattcaaatcaaaatctacattatgagctacaaaaatgcaatcttttatcttatcgtagatttcttgtgcaacttgattaaaatatggcgcttgttgtagcatattttcttcaatggatgttaacgcttgaatgaacggcggaatctctaaatttgttctaatcatagaatgatatgtatcaataatttggttattgcgcacaaacgttataccaatttgaatgatatc

SEQ ID NO: 2382 - DNA, 53 bp; double-stranded, linear
tattttgttaataaagttaatatatgtttgttgtacagatagttcaggataca

SEQ ID NO: 2383 - DNA, 59 bp; double-stranded, linear
cccgagcttgccctccttcccccctcttcgcctccagacgaagtgcccttctgtccttg

SEQ ID NO: 2384 - DNA, 110 bp; double-stranded, linear
agccaacatcccngatggtacttgcattaatgcataacctagagagaagaatgatgccaataaaccaaattgtggttttgtcatccctaaatcatccatcatttgcttag

SEQ ID NO: 2385 - DNA, 50 bp; double-stranded, linear
tgaaagttcttttangcatcaattttaanactacgagcggacnctaatat

SEQ ID NO: 2386 - DNA, 245 bp; double-stranded, linear
ggcaatttattgacacaatgcttgagcnattgatagcaggacaagaaagaatacttgatgagttaataccaaaaatggatgcgactgaaaaattaacgctttatttaactagtcattataaacagatagattatgaatttttgtatctcctttcaatggataaattgtttggaaataaaagaaatagattaacattaattgatttagaaaacatattgggagtaggaagagtaaaaattagtngt

SEQ ID NO: 2387 - DNA, 140 bp; double-stranded, linear
cacaaaattcgaaatcgtcatcggtgatatgtttaatacttgggaaaatataaaacgcgccttcaggttgagcggtaatctcaaaacctaatttagttaattcagatactaaataatttcttcgttcnacataagcttcg

SEQ ID NO: 2388 - DNA, 120 bp; double-stranded, linear
atataacattgtagggcctaataatttattttatgtctcagactcatacaatggttatttaacttatttaccacaaattgagcactaagactcactattatcgattcttctattgaacan

SEQ ID NO: 2389 - DNA, 85 bp; double-stranded, linear
tctaaatccagcatgatctacatcaaagctgaattcacctttttcatcgacttgcaaatcagggaattcttgaccttcacctagt

SEQ ID NO: 2390 - DNA, 61 bp; double-stranded, linear
ggtgtttataaagcaggggctgagcctcggtcaggactggatacacaggcagtacgggtga

SEQ ID NO: 2391 - DNA, 51 bp; double-stranded, linear
taaagtaaccactttagatgacattttagaagttatgggccgaatgcaaac

SEQ ID NO: 2392 - DNA, 50 bp; double-stranded, linear
ggtcggantcccgggtcgacccacgcgtccgcatcaacctagnagaagcn

SEQ ID NO: 2393 - DNA, 55 bp; double-stranded, linear
atttccaaacgaattgaaaaacggacgtaaattcttaactaaaggcgataaatgt

SEQ ID NO: 2394 - DNA, 120 bp; double-stranded, linear
ataggttgctactatttatatcgactcattttcacttacaaatatgacattgtctctagaacacnaaaattaatttgcgtcatatctgctacagttttgagtgtgttatcaagtgtattt

SEQ ID NO: 2395 - DNA, 261 bp; double-stranded, linear
tggaccatagtaaagcattacggtcggtttattattttctaaggaagtatgtttatataaatctatgctcatttgttttttagcgtctgtttgacctattattttagaaccagccatctgctctttataaaaatttattacatcatctttttttaatgttgtatattcatagtttatttctattatntcagaatcgtgaaaactatttagtgattganatactctttttggaggattctgaatatagattttcttaatatt

SEQ ID NO: 2396 - DNA, 104 bp; double-stranded, linear
gttttgaatataggggcttttatcactctccgaagtctnttctaagttagatttggaaaataacacttttttagtttcattcaagcgagtcgagtgactccaga

SEQ ID NO: 2397 - DNA, 54 bp; double-stranded, linear
gattatcgatcacagtatgatttacgtagcaatttctggtacatatacgcctat

SEQ ID NO: 2398 - DNA, 235 bp; double-stranded, linear
gcttcaccttgaactagcaaataaggataaaacaagcattctttacatgtttcttttaaatacgtttgatattttaataatactttttcgattttactcatataagtttgaagttctaatttttcattctcacttattttgtatatattacattcattatgttctgtcagaaaaatataagggtcaatattaatttcgtctatcaattcataaatttcacttaagtatttntnct

SEQ ID NO: 2399 - DNA, 111 bp; double-stranded, linear
tttgatgcacttatttgtgtaatgacatctttacagtcttttccttcctccatcattttaataattccatttagttgcccttgtattctattaatacgattaatcattttn

SEQ ID NO: 2400 - DNA, 54 bp; double-stranded, linear
aaatgctggctgagttttgggccacccgcaaaggcactggaccggtgcgaaacc

SEQ ID NO: 2401 - DNA, 205 bp; double-stranded, linear
aaccactcatcactactaaaatgatacttaaaaacaaagtcttaatacactttttcataatatcaacttctttctatatttaatacattaattatacatctttntnaaataaaaatatgtgtaaaattttaaaacttatttaattgatgttttaataatgtattatagaaattattgacatatgattaaaaacccttaggatagt

SEQ ID NO: 2402 - DNA, 140 bp; double-stranded, linear
agataatcatagagaaagtccacagtcggtagaggtggtagctgaaaacaacatactattaattatgaagtgctttgtaacttgtcgagacgtttgccgcgaatctatcatgatggtgatcaacgttttgtnacaaatga

SEQ ID NO: 2403 - DNA, 58 bp; double-stranded, linear
atttaaccactcctccaatgataagattgaaaggcaagatgaccttccaatcttattt

SEQ ID NO: 2404 - DNA, 61 bp; double-stranded, linear
cagcttctacaatacggcgtgctatagcaagcattaatgtaaatcctaattctgcagttgt

SEQ ID NO: 2405 - DNA, 217 bp; double-stranded, linear
aataatcattttaatacggtcttcaggaattgaagtgtctacaggtacatatccacatcctgctttaatgggcaccaatcatcccaacaatcatatatggtgacatgtgaccgantaaaatcatcgggtttctnactaccttgtaatcgatgtggctaatttactagactcatccattaactgttgataagttaattccatcagttgtgtgtctaac

SEQ ID NO: 2406 - DNA, 228 bp; double-stranded, linear
tttttaattgtatttacaattttatttaaagtatcaatagcaacatctctttcatcttgagtagtatccaacgtatttcggattgcatcgagttgatttttattattttcttcaatgctatcaagcgcanctgtattacgtcttactttaggttttatttgctctattgccttgattgtttgatntctaacatcagtaacagcagcatcttgatttgtattgtctatt

SEQ ID NO: 2407 - DNA, 110 bp; double-stranded, linear
cctttcgtctcgcgcgtttcggtgatgacggtgaaaacctctgacacatgcagctcccggagacggtcacagcttgtctgtaaagcggatgccgggnagcagacagcgat

SEQ ID NO: 2408 - DNA, 73 bp; double-stranded, linear
ggagaccccaaaaattttgtcgttgaagatgcctttttttaagcgttatttggctatatcagtttctaactgt

SEQ ID NO: 2409 - DNA, 53 bp; double-stranded, linear
aaatcattagagaggaatagttccctttgttacgccaaagattcgatattgac

SEQ ID NO: 2410 - DNA, 54 bp; double-stranded, linear
ccatatgattgtataggatccatgacgtctccactgacccctgactctagtatc

SEQ ID NO: 2411 - DNA, 204 bp; double-stranded, linear
gttcctcttcaattgttatatgtatatcacaaaaattatttcattattttaccattattattttacaaatattatcccaagaatacaattcaagaaatgattaactttactttagaattgtaccttattacattatttatgaaagtactctctcaattataacnaaaaagaaggtgttcaatacatncatatttagtcttatat

SEQ ID NO: 2412 - DNA, 56 bp; double-stranded, linear
cagtggcgcagaaacataacgctcagggaagcacagcacctcattatgccaaagct

SEQ ID NO: 2413 - DNA, 66 bp; double-stranded, linear
tcgctggcgggtcccgcgcgcctagcgtgctcatgtgcggtgttctaggtgttggggttgcagtca

SEQ ID NO: 2414 - DNA, 65 bp; double-stranded, linear
ggatagaaatgggaatccacccatcggtgggggtaccaggctcttcatatggccttgtggacttc

SEQ ID NO: 2415 - DNA, 267 bp; double-stranded, linear
ttaaatagatagaatagaattaaagagacgatgataggtgctgctatcgtcttaaaaacgatgataaaaggatcaaaaacatatgatactttttcgaaaataaaaataacaatacccaacaatactagcgctattaatgagaagactaaatcattcccaccaacaaacttcatataccgtgattcggtaaattttnnaaaattctttcttatattcttttcattttcattcaattatagattcaccaccacttaaaatattcataag

SEQ ID NO: 2416 - DNA, 50 bp; double-stranded, linear
ttaaacaaatgaatatagtagttccattatcctcacttttaatcgtttat

SEQ ID NO: 2417 - DNA, 177 bp; double-stranded, linear
tttgctgggagttgcattaagaaaatatacacatttacttgacattcaacttgataaaaaattagttattgccatatgttgcatcacatttatagggattttaatattttatgtacgcctaattaaaaaatcatctttaaatatttataatactaaaaataaaaggtcaaaaatntt

SEQ ID NO: 2418 - DNA, 400 bp; double-stranded, linear
aaaatgaagcggtcgcaaaatataatgacgtgaaagcattttatactcatggacatttatatcaagtcaatcgaacaagagatttattagctgaaaaaggacttgaattaggttgtttgtttgcattttatggacatacacatgtggcaaaatatgagtatattaatggtgttcatgttattaatcctggaagtatatctcaatctagaagttcaatggaagaaacatatgctgaagttattattgatgatcaaactttacatggcaccatcaatttcaaaaatcgacatcacgaaacaatcagtcatactactttttaaatagaantagctatggctttttttagtttatagactgatttaactaggaggtcgtgtcatccaatgtttgtttaaaagta

SEQ ID NO: 2419 - DNA, 53 bp; double-stranded, linear
agggtgccgagttaaccaagaaaggccgttggttgccccgggtattttccccc

SEQ ID NO: 2420 - DNA, 58 bp; double-stranded, linear
tccaaagtcgagagaggccagagtccagttagttttgtcgtgtgttttgcgagttagc

SEQ ID NO: 2421 - DNA, 152 bp; double-stranded, linear
accagaagacaataagtgtaatgatgcctgttctaatacagaatctttactttttattgccttttcaagtcgttgttccactttcttaatttcattgttcatgtttaactttgccangttaatcacctttggtattatctttttctttatag

SEQ ID NO: 2422 - DNA, 307 bp; double-stranded, linear
gtacgttttcattagttgttatatttccatcttgataattttttaaatctttaaaatcagcatactgactaaaaaatttaaaattttcaattttttgtntaagtttttgtcttctacattatccaaaagaacaatctnattattttttagttcaacacgatattttttctcattatgatttttgctaatatcatcataaactttatttacaaaataataacctgttgcctttttggtatttctattaagatataacaccatgccttcatcatctaatactcctggtttgttactttttgaaaaaccn

SEQ ID NO: 2423 - DNA, 56 bp; double-stranded, linear
attgtgttgtattttagacaagaccttcaattttggagatttcacgatttaccacc

SEQ ID NO: 2424 - DNA, 50 bp; double-stranded, linear
agtcctttggatcgtcaagatttcacacatttacanttattanctcgtga

SEQ ID NO: 2425 - DNA, 248 bp; double-stranded, linear
atgtaatattacaattcaattagnaaagaactttatctttaattgcttttcgatttcattcatgtcatcttctgaaattattatcgttccagtaggatcagaatcatttattttgcttatacgtcttttgcttattgttgtaattgctgatatattaacgtatgtatctttccctttgtgcttggaataaacacctatcactctatacagttcattagctttttganttaagttagacaaaagctttt

SEQ ID NO: 2426 - DNA, 53 bp; double-stranded, linear
ccttattatatgacaggttgcctaaacaagtgcctagagaaaaaactagcccc

SEQ ID NO: 2427 - DNA, 173 bp; double-stranded, linear
ccaaaatagaaattcaaaacgcacttgttgatttgatggctgaatatccttttcaagaaatatccactaaaatgatttgcgcgtattgtaatattaatcgttctactttttatgattattacagggagcaatttgatttattggataccatcaactcnaagcataggtggagg

SEQ ID NO: 2428 - DNA, 50 bp; double-stranded, linear
tacttatgtttatgtcgcaataattaatgttcganttagtggaattgaac

SEQ ID NO: 2429 - DNA, 68 bp; double-stranded, linear
agtcatcatattatcaataatacgccgcgttaaatctgataaattcatatagtctgtatctaactctg

SEQ ID NO: 2430 - DNA, 374 bp; double-stranded, linear
tgaattgaaaacggtcggtgaagcgctaaaaggtagacgtgaaaggttaggaatgactttaacagaattagagcaacgtactggaattaaacgtgaaatgctagtgcatattgaaaataatgaattcgatcaactaccgaataaaaattacagcgaaggatttattagaaaatatgcaagcgtagtaaatattgaacctaaccaattaattcaagctcatcaagatgaaattccatcgaaccaagccgaatgggacgaagtaattacagttttcnataataataaagacttagattataagagtaaatccaaagagccaatacnattattagtaatcatgggnattacagttttaataactttattgttatggg

SEQ ID NO: 2431 - DNA, 57 bp; double-stranded, linear
tgacttcgtccaagtacaactgcagtcagtacctacgaaatcaagatcagcatggat

SEQ ID NO: 2432 - DNA, 225 bp; double-stranded, linear
attcttaatcgcatcataattaattaacggacgcataacaaatccgataatactattatctttccaagtcactgacactccaaattgatttgcttcntctatccatatttgctcaatagtaccatcattttgagtacacacttttaattcatgtacatcagactgccttgtataagatttgaaaagtttcctaaactgccaataactgnactctcgcttcaaatt

SEQ ID NO: 2433 - DNA, 57 bp; double-stranded, linear
cggcctgacgttacatttcttcaacttcacgtcaaaattgcttcgcaataaccagga

SEQ ID NO: 2434 - DNA, 104 bp; double-stranded, linear
ttaaacgtgtctttaatgtggaagttgaaatattagtccgtaaaaaaatgaaacttaaaaaaaaataatatttatatttgtcgtacaaagatgaaagcganaga

SEQ ID NO: 2435 - DNA, 51 bp; double-stranded, linear
tttgctaatcgtttcacggattgtggggatgggtaaagactttgctagtgg

SEQ ID NO: 2436 - DNA, 140 bp; double-stranded, linear
aaanttaatttttggggggcccttttttaaccggaaaatccaatcggggcttttaaggaatggttttggttaacaggctttggaatttggtttggcaaaacaatccttggtttggggtttcggtccggagggtcctaatt

SEQ ID NO: 2437 - DNA, 400 bp; double-stranded, linear
gaagcggaaccaccgttgtttttcttttcaggtccaattgaataaatgttatgaatagaatggataaaaatataattatttaagtgttaaagtaaaccaaatcatgatttaagattataagaaagaaaaattgactaatgttaaaaccaacaatcatatgggttgtaacgtttatacaatcatcgtaaaactcaatatgcttaatttattcaaaatgttcgtcaataagtacaatgaaaaggagattgatttttgaataaaaaatatcttatgattgtaattataattttaatatgattctaggcggaatctttttggaantggaatatggccgaaaggaatatatggtggaccaaaaggaagatacgattttgagaccatgtgaagggattaaatatag

SEQ ID NO: 2438 - DNA, 59 bp; double-stranded, linear
tctgttttgaaagttgcagtttggacagcacccgatgattaggtgagtcttttggttta

SEQ ID NO: 2439 - DNA, 50 bp; double-stranded, linear
ttggtnaaaccgttacagttgcaagttttgaagtgagttattttttggtt

SEQ ID NO: 2440 - DNA, 50 bp; double-stranded, linear
attaaaaataaattaaangttccagaaccagttaaccagaatatttacga

SEQ ID NO: 2441 - DNA, 54 bp; double-stranded, linear
tgctgttttggcggtttttctccgtttggttgagtatgtggtgtaccttttgtc

SEQ ID NO: 2442 - DNA, 56 bp; double-stranded, linear
gttgttgggtgtgtggttttgggtgttgtgggtttggggtctgggttcgttggtgg

SEQ ID NO: 2443 - DNA, 264 bp; double-stranded, linear
gagacaaactagtcgtccagaacggaatttaagtaatcataataattacggaagtgcacttttgtttttgatttatcattgatggaaattagaacaatttatcgaatgatattaaaattacataacatcatgttgaatgtgaaattaggattgaacattacctgtntatttgaaaaaccttcagtttttaaatcactagtatcacaaataaagcgacttaaattcgattcgttaataatagataatgcaaatttangtagccct

SEQ ID NO: 2444 - DNA, 67 bp; double-stranded, linear
ccgtctttagtacgtacgttgtttgcggggcttggggtgctttctgggtgttggtcattgtattggg

SEQ ID NO: 2445 - DNA, 58 bp; double-stranded, linear
agctgcatttctcgtgcaggctatcagcatcgatatctgtaccatttagtgatcatgc

SEQ ID NO: 2446 - DNA, 53 bp; double-stranded, linear
aaccaaaacaaacatttgttcgttaaaatattgacacagaacataagttctga

SEQ ID NO: 2447 - DNA, 50 bp; double-stranded, linear
cacaaattacacccattgttantactaatacttncctnttcatttgttta

SEQ ID NO: 2448 - DNA, 75 bp; double-stranded, linear
gcacaaaccaaacgcaccttaactgctttaaatggctggacggggggtcaactggccttaatgacacttgaatcg

SEQ ID NO: 2449 - DNA, 71 bp; double-stranded, linear
gcagccttcaagtgtttgctatttgctttggtgtcacaagccattatctacggtcccgcaatttagcccgc

SEQ ID NO: 2450 - DNA, 351 bp; double-stranded, linear
tggcgtgaggaaaaatatcatgtattgttacacagtcaacagtcttaccaaatgataaggaatgctttaaaaacggatttatcacttcatcaagttcaacaaatgattgatgttgctttgttaattgaaccgggtataggaagtgtatgtaatgcttttgatcatatgtggggatatttaaaaaaatgtgcgaatgaagaaggaaagacaacaatcaaaactacttaaaagctgattttatttaatggnaaaaatcgacaccccaactttattagattttttagcagaacttgcctaataaatatggangtcaatatttactacaaagccgngtttttaaaccccaaaaag

SEQ ID NO: 2451 - DNA, 54 bp; double-stranded, linear
gtgtaccgcctcggctggcgttcgcggtgggtggtgcggtcggtgcgtgtctgg

SEQ ID NO: 2452 - DNA, 50 bp; double-stranded, linear
tgccattccaatgttaccatcgtcttggtactactatatactgcggctat

SEQ ID NO: 2453 - DNA, 400 bp; double-stranded, linear
agacgtgtttccacggtatgggataaatgaagcaccgactgataaatcaatatagcctcgtgtttttagtttacccgaactatcccttgataatgattgtgacatctgcggataatatttcattttcttagatatcgtcgaaatatcaccgattacttgaagtccatctgtcgtaaacaattcaattctgctttgtttgtttttacttggggcgtatgtcacttcggcaatatatcgtctaacttcaggtgtcatttcagataacgccttaatcatatcatcttcttttgtacctttgaaaccatccatgacaggtgcatcattaattttgacatcatttgaacctttaagcaatttaccattttctaataaaggtaaatatttacctttatatttcact

SEQ ID NO: 2454 - DNA, 156 bp; double-stranded, linear
agaaagaaataccatttggagatagagactcgtgttatttcttagcgatgggagatttttataataaagaagatagnaagaaaattatcaaaggttatgaaaataattatggtagaggtattaatattcctcgagcacatagtatatatttatatg

SEQ ID NO: 2455 - DNA, 77 bp; double-stranded, linear
acttaggtgatatgaaatgtggtccgcgacgatcgtcagtaacaaaataacaggcagtcattggattatgtttaacg

SEQ ID NO: 2456 - DNA, 65 bp; double-stranded, linear
agtgaaatcgctaaagaaaaagatggaacctcggtatctaatacacaacttcttgaacgttttta

SEQ ID NO: 2457 - DNA, 54 bp; double-stranded, linear
tatcaataattgccacttgcaatgactgattaatttgaggtgcacataagccag

SEQ ID NO: 2458 - DNA, 166 bp; double-stranded, linear
aattttatttcgagattcttcaatatagatgtttcttcattaatttgattctctaactcttgcttactacctaatagtttatctaattcagctttagctttttcattttctttaattatattaatttcattatttatgttcgtnatcgtattatttagttcgataa

SEQ ID NO: 2459 - DNA, 66 bp; double-stranded, linear
ccaatgattaagcaatacaatcgtcactaaaattacaccgataatctgaatcatcgtcatgcctct

SEQ ID NO: 2460 - DNA, 103 bp; double-stranded, linear
aaatcaaaaaaatgtataatgaaaagaaaaagaaatttggaaaaaattgggaagacgctcaaaaagctggaaaagctgtaggtgaagatttgagtgtnaatgg

SEQ ID NO: 2461 - DNA, 52 bp; double-stranded, linear
tttatatcagaatagaatagtaaactaaggcatttggagaacttattccatg

SEQ ID NO: 2462 - DNA, 113 bp; double-stranded, linear
cagcagcgaatttttgacgtccagtgtagaatggatgtgaatcagatgaaatatctaaacgaataactgggtattcttttccatcttcccactccatcatttctgaagangtt

SEQ ID NO: 2463 - DNA, 255 bp; double-stranded, linear
aaacatctgcaatttcttgtgcgagtgctttaataatataactgaaatacaatgtaatagctaacataattgttaacactaaaatatttactacttttagaactgtgcgattaaatacaattgtcagtattgttatgactaggctaacgatacataaaataaagaaaccgttaaagactaaaattaagcgatcgattccttgttgtaaatcattgatattacccaaattaatanttaattggatgcatttnccaa

SEQ ID NO: 2464 - DNA, 58 bp; double-stranded, linear
tatgcgacaattcgaaacattttatatgcaaaaggttatacaacagagaatgttgatt

SEQ ID NO: 2465 - DNA, 65 bp; double-stranded, linear
tgaatttcattaccacatatcggacattgatctccaatatttacagcagatttaatttcacttat

SEQ ID NO: 2466 - DNA, 51 bp; double-stranded, linear
cgtgaccttcaaagaccgaacgagagagttgaagagcatttgcgaaggcca

SEQ ID NO: 2467 - DNA, 55 bp; double-stranded, linear
agtttgttaagttttagtttactaacttttccattagatattattaatgaaaaac

SEQ ID NO: 2468 - DNA, 76 bp; double-stranded, linear
ttgttggtaaggcacttcttaaatatcaacaacgcgatgatattttcattggtacaaaagtaggcaatcgtttaac

SEQ ID NO: 2469 - DNA, 71 bp; double-stranded, linear
cttctataataaaaccatctgcaattaagtcttcaatagacgatggatttctattatgtatcaatgcatac

SEQ ID NO: 2470 - DNA, 52 bp; double-stranded, linear
cttcgtcattgtattcgagcgcctgtatagcttgctcaaatgatgcataaat

SEQ ID NO: 2471 - DNA, 108 bp; double-stranded, linear
agaggttatgttgatgtgctttattttcatcaatgtcattaacacaatcatatttcttctgttaatgcactgtattatattcaaacgcgctatcgacaattaatttgn

SEQ ID NO: 2472 - DNA, 400 bp; double-stranded, linear
gtccccagttgatataggatcacagtttaatatacttggtgagatagtaatactattattaattcaaataggtggtctgggtatcgtgaccgtaaccctattgacactagtatttttaaatagaaagatatcaatgaaaaatagattcttgattatggttacatggaatattgacgaacctggtggtgttattaagctaattaaacacttggctatttatagtttagtcactgaattaattggtatgatttgtttgtgtttatcttttataccaaaatttggtataggcaaaggtttatttttaagcttattcacatcagtatcagcttttaataatgctgggatttgccctttttaagaataacttaatagattattctagtgatccaattgtcattat

SEQ ID NO: 2473 - DNA, 147 bp; double-stranded, linear
cttcaaatactaaatcagcgttgctaaacataccgtatacatttgatggcgttgataacgcgtcctgcgcttctgttaataacttttcagtttcagcatctaanatatgaggacgtttttcattaatcaacttcaaatcaaatgcga

SEQ ID NO: 2474 - DNA, 62 bp; double-stranded, linear
ctttaggtgcttgtggtaattctaattcacaagatcaaggtaacaaaactgaacaaaaaaca

SEQ ID NO: 2475 - DNA, 50 bp; double-stranded, linear
cctttaaaatcatctagaatatctcttgagaaaaattcgaaatctacagt

SEQ ID NO: 2476 - DNA, 113 bp; double-stranded, linear
atagtggttagtcaatgtaattaaatgagaatagaatggtgatttcatcttagcttgataattagcagaatctttaaagaaaattttgtcttncaagcctaagtttacaacgt

SEQ ID NO: 2477 - DNA, 51 bp; double-stranded, linear
cgtaactaactcaatttactgaaaaaatcgcttgcgatgcaatagcatttg

SEQ ID NO: 2478 - DNA, 60 bp; double-stranded, linear
tagttgccgctacgtttatactcgtattaatgaaaaaaactagcaaagaatctaaaaaag

SEQ ID NO: 2479 - DNA, 52 bp; double-stranded, linear
tcggacatgatggtaaaaccgtattgggtattcgcactgacaccttaaggga

SEQ ID NO: 2480 - DNA, 133 bp; double-stranded, linear
ttcctaattaaggattaaaaagggtttcctaattagattanaattccgggacctggatggaaaaaagtttttaacttttccatctggtcccgttttttgattttcgatataaaaaaagcgcaattatctctat

SEQ ID NO: 2481 - DNA, 400 bp; double-stranded, linear
aaatgttttggaagaacgtaaganaaatcaatctgaaacaaatgcacgatatgaagaagaacaagaaaatttaatggagcttttagaaaatatatcaaatgagatttctgaagctcaagatacttataagtctctgaaaagtaaacaaaaagaactcaatgctgtcattcgtgaacttgaagaacaactatatgtttcagacgaagcacatgatgaaaaattggaagaaattaaaaacgaatactatacattaatgtcagagcaatcagatgttaacaatgatattcgttttttaaagcatactatagaagagaatgaggctaaaaaatccagacaggttctcgttagttggagttttgagccattgaaagtattcngggggccaattaaaaccgccaaa

SEQ ID NO: 2482 - DNA, 68 bp; double-stranded, linear
aaggtgcatagtcaacaacatttacagcatcatttgattctgaactaaccgaaacattatacttaccg

SEQ ID NO: 2483 - DNA, 50 bp; double-stranded, linear
atgagccnacacagtggtgaggtaatcaacggtacagtggttagtgtgat

SEQ ID NO: 2484 - DNA, 213 bp; double-stranded, linear
cggaactcgtcgaataactttttagattcttcgttagcttttacattagcgaatgcttctntgattgctttgtattcttcgctttctcttaaagcttgttctaattgatttgcataatcatataaatttactgccatggttatagcactccttggtngtgatgtttattaaaacgttcgatattactttaccacatctcgcttttttagacaa

SEQ ID NO: 2485 - DNA, 376 bp; double-stranded, linear
gaccaaaattatctttagcacttataggtatctttttaatactttgtgagtttttctatggcattccttttttaggtgcaacgtttattttaagttttggatggcagcctttactctttaatgcattactttatctaattcttactattatattattagtgaatagacaaaatgcgattagacctatagcgattattccaatatttggtatagtaggtagttttttagctattatccccttcttaggaattttgattcattggattttatttttcctaatgattccanttgtcctagttggattatcagcgccaacctatatacccaataaaaatgctcgtgncnttttacacacaatacaaagatggacctagag

SEQ ID NO: 2486 - DNA, 51 bp; double-stranded, linear
ttgaccttgacggaaacttttttccaagttctaaaagtgggccaaaatctt

SEQ ID NO: 2487 - DNA, 103 bp; double-stranded, linear
gaattttggcatacacatacactttaaaagatattattgaaattacaggtgtaactaaaagaactttacattattacgatgaaataggattattagttccagn

SEQ ID NO: 2488 - DNA, 106 bp; double-stranded, linear
aattacattagcaccaatccacacatcatttttaattgttgtacggctaggttggtcattaaagtctataaacgtttnctttaagttaaatggattattatttaga

SEQ ID NO: 2489 - DNA, 61 bp; double-stranded, linear
tgaatttgcttgagtcgtgctgctgataacaataaaattgcacatggataaagaatgacgc

SEQ ID NO: 2490 - DNA, 400 bp; double-stranded, linear
gctcgtatgatacaaattcataatctgaaacttctgtcgtttgtcgaacatgtggtaaccaattcttcaagatgctgtatatttctgcgtaattttcgtcattcctgaataacctcaactttaaaatgtcaccttgtttgatataacgcattaaaaaatattgatctatatctcccttatctttaagatgttttacaaatggatacaaattgtcgatgataaatgtatcttgcgatggcttatcgatatgaatatgtaatgcaaaccagtctttgtcatattcaatatctgtatttttatattttggaatttcgatttcgggtcctcgataagatgattttttataaattggtgtaacaatttcatacacatgatcattctttgattgagggaaaaatga

SEQ ID NO: 2491 - DNA, 57 bp; double-stranded, linear
gactgttttatcgcaactatttacacctatattatcgttagtaggacatctcgtcgg

SEQ ID NO: 2492 - DNA, 53 bp; double-stranded, linear
cattgaacttgcttttgacgtacaccagtaatcaatgccataatacgatccgg

SEQ ID NO: 2493 - DNA, 50 bp; double-stranded, linear
aatacaactaacatacacttacccatgtccgaagtccntgttgaggaatg

SEQ ID NO: 2494 - DNA, 65 bp; double-stranded, linear
gctgtttagcttgctcaaatgatgcataaatatctgatgcaactatcatatcagctagttcatca

SEQ ID NO: 2495 - DNA, 322 bp; double-stranded, linear
ccagtaactgcaattgaacaaacatattgggtttttgaccaacatataaacgacagaggtattaagctttctaaatcattgatgttaggagctaatgtgctcgataagcagagtaaagaagaattgcttaaacaagctaaacatataacaggtttagaaaatcctaatagtcctacacagttatnggcttggttaaaggatgaacaaggattagatatacctaatttacaaaagaaaacggttcaggagtacttaaaagaagcaacaggaaaagctanaaaaatgctagaaattagatngcaaatgtctaaaaccagtgtga

SEQ ID NO: 2496 - DNA, 59 bp; double-stranded, linear
atcagtgttaattcgcacggaatttccttccattaaactaatccgatcatataatggat

SEQ ID NO: 2497 - DNA, 126 bp; double-stranded, linear
ctaattaagccaaaaggggaagggtccaccaacccttggtttccccccattgcccggaaaccaccagnaagtttaaagcttccctttaagccgtccgatgggtagtccgaactttaccgttcccgc

SEQ ID NO: 2498 - DNA, 58 bp; double-stranded, linear
cactttgcgccagttttcagttgagtggcatagagtctgctcatcagttccttgctcc

SEQ ID NO: 2499 - DNA, 90 bp; double-stranded, linear
tcatgatgcagacgcaacagcatttggttatgaatatggacaaataccacagatgccggtagcatttcaatcaagtaaacctttaataga

SEQ ID NO: 2500 - DNA, 292 bp; double-stranded, linear
tgctcaaagtcgtgtagacagccaactaatgcattttcaagatcagtgacatctccgacaccaaagaaatcaccgaatatttttgcatgttcgattttacctcgtttaacatcaaacttaatttgtacaaatcctttttcaaatttttcctcgcgttcaaagttatatttagggtttctaccataattccattcccaagttctatatttgtcgttacttaacttttcaatattntcccaatcttcatccgttaattgatattcttcnacttcagtttcgccaaagatagttt

SEQ ID NO: 2501 - DNA, 58 bp; double-stranded, linear
ggtgtgtgtagaggtcgagagttggggggggagtaacgtggaagttgcccggacagca

SEQ ID NO: 2502 - DNA, 50 bp; double-stranded, linear
atacgggaggtatcagcacgtacgtgcagtcggtaatggatcnaaatacg

SEQ ID NO: 2503 - DNA, 400 bp; double-stranded, linear
atccccactcttttttaaatgatttaaccatattttatttttaaaataaatatccatcaaagtgtatcaataaatttatcacatgtcagaaagtatgcttcatctgaatacaccaatactctcatgaaacttattaaaaattactctctcaacgtaaaanaccattcaaattcatgaatggtttggaagaatgattcattgttacgctatttaatcactacatcttaattattgttgctctaaacgattacgcttaccatttaagaaagcataaacgagacctacaaaaataccgccaccgacaaagttacctaagaaagcaaaaacgatattttttaaaacgtgtaaccatgaaactgcatcaagggtaaagaataccatacctgcatatagacctgca

SEQ ID NO: 2504 - DNA, 355 bp; double-stranded, linear
attatctatgaataaaatttataataaacatatattgagaaattctctaatacctattattacatttttaggtgctgatattgtaagtattttaggtggagccgtgattacggagactatcttttcatataacggtatcggtaaattatttttagaatcggtaataggccaagactatccattaatgatggcattaacgttatttttctcatttttaggtttactgggtaatttgatttctgatattacttatggatttatagatccaagaattagaagtaactaggggggattagaatgcaaaataagtcaaaatcgcctttnaaaattgcattttctaaattnattcatanta

SEQ ID NO: 2505 - DNA, 254 bp; double-stranded, linear
ccgttagttccataccatatttttttctataaaataatttaacatctaattgcctttctaatttttcaataggggtagatacagttgactgtgaatagttaagtaactctgatgctttagtaaggttctttgtttcactagttactaaaaatgattttaaaatgtttaagttcaaagtagtacctcctttagggttcccttttatcgaatcctgaattctaagaattctgatttaataataatatatnanatat

SEQ ID NO: 2506 - DNA, 268 bp; double-stranded, linear
aactccaccgtgtagttgcgcttcatcgccttgaggatgcgattggcgccgtgctgcgcggcacgtgcagatagtgcgagcacttgggcagatcgcgcaccgcctccagcaggtcgtcggtcatatccttgggatagttcgttacganttggatccggtcgatgccgtcgacatccgagatgcggcacagcaggtcggacagtcgcgttgnccgctggcagtgtcgtagtggtaatgtttcacggttttgacctagcagcgttcacct

SEQ ID NO: 2507 - DNA, 66 bp; double-stranded, linear
aaaagtggctaatatcatcagcagaatgtataacataatcgaattgcaaccagcgattataccttt

SEQ ID NO: 2508 - DNA, 53 bp; double-stranded, linear
acctccgcttcaaatgtcattgatagacatttaaagcggaggcatgtacatgt

SEQ ID NO: 2509 - DNA, 50 bp; double-stranded, linear
accctatganagatgaagtnattaaccaaaaaccacgtgttgtaatatta

SEQ ID NO: 2510 - DNA, 57 bp; double-stranded, linear
ttaacctattatattaattttagtatcaattctttctccagttcctgcgtcattttt

SEQ ID NO: 2511 - DNA, 51 bp; double-stranded, linear
acgtgttcataacccataaaggcgaatatggtaacaccgaacatcatgaca

SEQ ID NO: 2512 - DNA, 101 bp; double-stranded, linear
gtanagcggtccgcgcttaaagcgcttgctaacttcgaacaatgaatctgcggaacatcttgcgaatccacgagatgatctcatatgacgggcagcgaggt

SEQ ID NO: 2513 - DNA, 67 bp; double-stranded, linear
gggtaatgtaatagtattcatctacatcatcttgatcatcgtaatgctgattgtacccttctaaatc

SEQ ID NO: 2514 - DNA, 50 bp; double-stranded, linear
cccgtcgttttcgtgnttttcgcggcgtgtctcctgttcgcgcctctact

SEQ ID NO: 2515 - DNA, 275 bp; double-stranded, linear
aagaaaatatctcttgaatactgatcgattgccatcgaaaaacactgttaaatcaagttgcccagtccattgttgttcatccattatgataatcctttgagtaaagtgtcgcgttcaatccaatcgataacttcatccaaaccttcgtcggtttttaagttagtaaaagtaaatggacgtttaccacgaaatactttagtatcttcagccatttgttctaatgatgcacctacatanggagctaaatcagtnttgttaattacaaagacaatctg

SEQ ID NO: 2516 - DNA, 59 bp; double-stranded, linear
ctgcaccaccaataacgtaaatactgtatatactagtaatcgctaatacaccgatatta

SEQ ID NO: 2517 - DNA, 119 bp; double-stranded, linear
tctgctactacgtatacgatagaatggatttctttttgaacctaaacgtgttaaacgaattttaactgccatttataaaatctcctttaagtcatgttttaatttttattttctacang

SEQ ID NO: 2518 - DNA, 60 bp; double-stranded, linear
atttccttttaagtttttaaaaatccaaaatccttgtggtagggccatgaaagggttggg

SEQ ID NO: 2519 - DNA, 294 bp; double-stranded, linear
atagaagtgaagcacgtagattgaaacgatggttaaataacgagagacatttagaaaacaataaaaatgaggaataatcaatgatacatggaattggtgtagatttaatcgaaatcgatcgaatacaagcgttatatagtaagcaaccaaaattggttgagcggattttaactaaaaatgaacagcacaaattcaacaatttcacacatgagcaacgtaaaattgaatttttagctggcaggtttgctacaaaagaagcgtcagtaaagcattaggccccggcctnnggaaaca

SEQ ID NO: 2520 - DNA, 145 bp; double-stranded, linear
ttttaggccgaagangtagtaatttccggtcctttaaggggcgggtggttaaccatggcaattaatcccagggatgaccttacctaataaccacctaataattacccggaccaaaggtggaaataatccctccggtccttcccgg

SEQ ID NO: 2521 - DNA, 169 bp; double-stranded, linear
ttttagtcaccaaaattctcgcatttaactgatacgaatgtgcaataactaaaaatcgatctaataattgcgttgaaaaatttggctcgacagcactcattacaattacnagtgtatctatattacttacaggtggtcttttcaactcattttcccgctcaaacacttg

SEQ ID NO: 2522 - DNA, 88 bp; double-stranded, linear
atccagcctttcaacaaataaatctgaaattcgatgttctaaaatttctgcttcttgatgtacttcttcccaattatatttcaatatt

SEQ ID NO: 2523 - DNA, 228 bp; double-stranded, linear
cagtaacatcaatctgtcctgtaagcttgtggtactccgatacaaccataagtcaacgcaccaccaaaaacgccttggagccgttctacttattagtccaagtttagacattgaaataccaacaactttgcantccatagtatctgaaaatgtagacattgcctgcaataaatttaacncatcatttttattatgtggcattactgctaatttaacgtattctgggtt

SEQ ID NO: 2524 - DNA, 119 bp; double-stranded, linear
ctcatccatagcgctggtattagtataggtgtcaaaccattagcgtatatcatatcttctggatgtnctcacatattcatagatgcacattttacttctctcgtaccttagtactggga

SEQ ID NO: 2525 - DNA, 357 bp; double-stranded, linear
taccaatattaaatttgaacattatagtttgaccatcataatctatcttctctatttcattataactaatacttctataataaaattggccattcatatctacattcataattaatctttcatttgttgctataaatgccccttcaaattcattctcaccttgaacttgatactcaattattcctagcactgacggaccctttttttcagttggaaataaatcatttggattcacattatctaaaatcataatatccctcccacttaaaactataaactattcttcataggtatatgaaatacaagtgattaactattnatnatnaagcttaacttgtattcccttttcaagataat

SEQ ID NO: 2526 - DNA, 261 bp; double-stranded, linear
cacgcgtccggccacctggacatggccgacctagaagccaagctgcangaggcccagaagcatcggctgcgcctgggtggccactgatggggccttttccatggatggcgacatcgcacccctgcaggagatctgctgcctcgcctctagatatggtgccctggtcttcatggatgaatgccatgccactggcttcctggggcccacagnacggggcacagatgagctgctgggtgtgatggaccaggtcaccatcatcaa

SEQ ID NO: 2527 - DNA, 108 bp; double-stranded, linear
ctntagaggatatgagttcctcatcataagaatttctggatccttaatagatctcttgctatatataatgtaatagaaacatcttttaaggatccagaaattcttaga

SEQ ID NO: 2528 - DNA, 109 bp; double-stranded, linear
ttttaaaatacttggtagaagttggaatggattaatcattaattatctctcaagatgtaatgactgttcagcacacttttccgatatgaaaagagatttgaanacaata

SEQ ID NO: 2529 - DNA, 150 bp; double-stranded, linear
gattaaatttgttatacctggcttgttgtcacgatcaaatttaataataccatctgaatcagttactgcgcttttaatttttttagctgcaacattcggctcgtctaataatgaaatngagtttttagcattatcatcactcttactcat

SEQ ID NO: 2530 - DNA, 127 bp; double-stranded, linear
ttctttttggccagtggcaggaagtacggtcttatttggtgttatgttaagaaggtattcccatttatttatcgttaaatatgnatatagtatagtaattttaatttgttgcatcataatactaggt

SEQ ID NO: 2531 - DNA, 122 bp; double-stranded, linear
cacataatgattcgaattattgttttaattaaacctttttcacatatgtataaattttanagagcgcatgcgtgaatattttcatttgattcaaaggcaaaagatagccttatactcttttc

SEQ ID NO: 2532 - DNA, 126 bp; double-stranded, linear
aaataatagagcaattggcacatgtaagaatgcaaattgactatggcatccagtattttggtcacaaatgggttgtatatgagcatgttgaaaaataagtcttatgntaaacacttagtaaaatta

SEQ ID NO: 2533 - DNA, 101 bp; double-stranded, linear
gagagcggccgcgtgtaaggagagcggcgttcgttcgcgtgacgcgagtgtggttcgcgagaagnggaccagagttcccgatcgaggctgttcgggtaaat

SEQ ID NO: 2534 - DNA, 112 bp; double-stranded, linear
ttgctcattaaagattatcccaatcaatatcatctatatttgttgtaccactattatctttttctctttctcttactttgtncattgtaccagtagattcaagatatattgt

SEQ ID NO: 2535 - DNA, 51 bp; double-stranded, linear
ataacgaatccaaaaatatagagaatgacagtgaaacttaaataggactct

SEQ ID NO: 2536 - DNA, 56 bp; double-stranded, linear
ttatgcaaatttggcgcatggattaggagattgtgctgggatagctgaggatttga

SEQ ID NO: 2537 - DNA, 158 bp; double-stranded, linear
ggatgtaccaccagcataataaacaacttcaaatggattgataaagaaganaccagcagagataggtaattcattaccatgttcttcttgtagacgtttaccttcttcaatcttttgctcatttgcatcaagttgttgttgtaagttatctcgcttgt

SEQ ID NO: 2538 - DNA, 50 bp; double-stranded, linear
tatattcattaaatccacaaagcggtcccgtataaacatgggtttccatt

SEQ ID NO: 2539 - DNA, 103 bp; double-stranded, linear
aaagtatacatatcactcaactaatcaataatcatacttaccttcaacaaattctttaacatgcagtgttatcccttgataatatggatatttngttaatcta

SEQ ID NO: 2540 - DNA, 56 bp; double-stranded, linear
caatcaatttgtctatctgttgagtggcaacctctaataagccttttatattgtca

SEQ ID NO: 2541 - DNA, 126 bp; double-stranded, linear
tggaaataacgaaagtattattaatttaaagcatctttctcccaatactttaatgagtgatattgtttatataccgtataaaacacctattttngaggaagcagagcgcaagggaaaccatattta

SEQ ID NO: 2542 - DNA, 201 bp; double-stranded, linear
atcagtttcttcaaaaataactgaagtatctgatgctgaaaattggaatagttgatgggtcgggntattgatttttatctgatgtaaaaatccataagtgccataagatgtatatagtttcttcatatgaaaggtcccccttatgtntttatttattatacgatgataaactagtcattaccactattaataattgattaa

SEQ ID NO: 2543 - DNA, 65 bp; double-stranded, linear
gaactttattacaggaatagataagcacagtcgtgttacacagacgctaaatgcgcgttcgtatg

SEQ ID NO: 2544 - DNA, 102 bp; double-stranded, linear
agctattaatggcgctataattgatacaatagttatgattaataaaaaaataaccgataacattgcaattttatnatgaataaatttaggaaatgcaatttt

SEQ ID NO: 2545 - DNA, 50 bp; double-stranded, linear
aatctacatccagcatgatcnacatcanagcnggattcacccttacttca

SEQ ID NO: 2546 - DNA, 100 bp; double-stranded, linear
aaccattcaacacacgacactaaagtgcagtacaatcctacaaaacgattgtttttatcgggtggtctaaccattgaataaataatgaataatggtaana

SEQ ID NO: 2547 - DNA, 156 bp; double-stranded, linear
attgaaaatcttttatcatttcatacgtgtgcataattaaaaaggtgaaacctcttattttgagatttcaccttttttattgttaatttaaatttaattttaatgattattttgtttcacggtgtaaagtttgtntgttttcacgtgaacagaatt

SEQ ID NO: 2548 - DNA, 142 bp; double-stranded, linear
aaagtgaaaattggaggtgtaattttgactagaacttataatattattggtatcctttcttgtcttatatcttttattattatggcgttaccaatnatttggtacacagcttcagcattatggttcttcccaggtgcaatca

SEQ ID NO: 2549 - DNA, 101 bp; double-stranded, linear
cccaaccctacnaacgacattacacaatcagtaacagatcggtattaagactggatatcgtggcatctgttgagttaatatcaacagtcgtccagaactcg

SEQ ID NO: 2550 - DNA, 72 bp; double-stranded, linear
tgtaaccatgatttagatgactaaacgtgcttgccaacatgcttcatccaatgccgaatcctttagctacat

SEQ ID NO: 2551 - DNA, 303 bp; double-stranded, linear
cagtaagaggacaaggctataaggtggagaatcatgtttaaaacactctatgctagaattgcgatttattccattacggttattttatttagtgcattaataagttttgtattaacaaatgtttactatcattataatttaaaagcatctaatgacgcgaaaatcatgaagacgcttaaagaagcaagacaatatgaacaatcagctaaaccaacgcacattcaacaatatttccanacatttagggtcaaatggaattaccaaataatgaccatggatccataaaggtcntnagaccttttt

SEQ ID NO: 2552 - DNA, 150 bp; double-stranded, linear
tttactttagcctttattgcatttgtaatttatagaactgcgaacaggtgactactgtnaatttatgtgattaaagtttcaatgatatttgatttattagaccattgcaaaagcgcaaggttctcatgtgctgctacagtttgcggtctt

SEQ ID NO: 2553 - DNA, 58 bp; double-stranded, linear
gcactcgtcaataaagatgaagcagcatttaatcaatatacggcagaatacaaaaatt

SEQ ID NO: 2554 - DNA, 118 bp; double-stranded, linear
ctaaagttgagaaagctaaaagtaaaatagagaaacgtacattcaatgactaagattactaaaatcgttgaataatcaatcatagcagtaagctatgtnatatatttttaaaaattga

SEQ ID NO: 2555 - DNA, 102 bp; double-stranded, linear
acaacttcaaagaaatcatgtcacaaaaaaagtatttgattttaatcatangtggcgacaatccgcataccaaagcacaacctttagtcaaccaattcagat

SEQ ID NO: 2556 - DNA, 242 bp; double-stranded, linear
agatgcattagcagcattagacgttaaaccagttggtattgctgatgatggtaagaaaaaacgtatcattaaaccagttagagaaaaaattggggattatacttctgtaggtacacgtaaacagccaaacttagaagaaattagtaaattaaaaccggatttaattatcgctgatagcagtagacatanaggtattaataaagaattaancaaaattgcaccaacattatcattaaagagtt

SEQ ID NO: 2557 - DNA, 248 bp; double-stranded, linear
tgcactcataatcatcggaatatgtatagaatcaactatcactttgccgtgtttatctgtgttaaatgtgtaaccataacagtgtgtcccatttggattatgaatctcagaataatcatcaaaaatatcctgaatttncaaattaatttcattatagcggnagcaatgtctataaaatttaaatataagttccccagtctctgatttttcttctgatataataaagcgttcagcattccatatttcaa

SEQ ID NO: 2558 - DNA, 400 bp; double-stranded, linear
tttgggtcgtgattgaaaaaatctaaggctaataaaccatgttgttctgcgcttaataattgtttgagtatacggttaataattaactctgtatcatgagggttgacgcgaaagtcagagcgcatataagtcatataattctcgaagatttctctatcagtattgcttaatcttaatgatttaacattattttcttttgttaattgcgcagtacttttcattgttacttaagcgctcctttaaaaatgtttaattccaaattaaaatggaaatgattttatagtattaataaggtcaatcatatcatattaaacgcataaatataacgattaatattggagaggaaaatgaggacacttaataaagatgaacataattatatcaagcaaatagctaatat

SEQ ID NO: 2559 - DNA, 333 bp; double-stranded, linear
aagggaaatttaaaagtatcatttgattatatagattggattaaattaggttttggcccatcaggaaaggaaaactactatatgtacaaaaaatttggtattttaccagatatggaatatgaaatggaagaaattcgagcagtagagaagtatgttaaagagcaagagtagcagacatgttataaaagactgtgcaaaatcaccctcgttttacatttgattcaaagaagaaggtaaaagataagantatttgcaacttaaaaagtcaatnagcttatcggtatccatacatcatggataaatgagtncaactaattaacaaatcacgatata

SEQ ID NO: 2560 - DNA, 87 bp; double-stranded, linear
gtaagacattcacatttatcatttcaccacaatgggtttaccaaccatggtttaacgaatccaaaactttgatgctcgtatgtctca

SEQ ID NO: 2561 - DNA, 117 bp; double-stranded, linear
ttgcattttgacgtaaatgattaaacaaatcgtgattatctcttaattttctaaccgccttttcaatttctaacggcgtaacttcctttagaacaatgccaaatttatatttntcat

SEQ ID NO: 2562 - DNA, 60 bp; double-stranded, linear
aagtcaaacaaaataagcaaacagactggtcagaagataagttgaataatatagctttga

SEQ ID NO: 2563 - DNA, 80 bp; double-stranded, linear
aagtgttattattgtgatcataaagtgaagtattaccttttttattcgtaacccgattccatgcgccttcaacataaact

SEQ ID NO: 2564 - DNA, 64 bp; double-stranded, linear
agacatgggcttatcagataaagtaaaagcattacctaaagggggaggcggtaagtcattaccg

SEQ ID NO: 2565 - DNA, 66 bp; double-stranded, linear
gtttgtttatagtaccctggattttctttatttccatcatgtgaaactgtgtcagtgaacgctgat

SEQ ID NO: 2566 - DNA, 75 bp; double-stranded, linear
ttaattatttgtgacgtattacacgcattactttagaaagtgattcccaaagcgaattatctttacgataaacta

SEQ ID NO: 2567 - DNA, 50 bp; double-stranded, linear
atattattatattgctttttttcagtttgccgttgttactttcataactt

SEQ ID NO: 2568 - DNA, 223 bp; double-stranded, linear
ttttaggatttgtagtaggtgagcgacgtattnnggatgcaatccagagaacaataaatattgagagagagcaattcataacgcagttgaaatacatgtgttacgaattgcttttatgttagtttttatcacacaagttttttgatgcaaccccgtgatagcgaaactcatatgtagataatacagctttttcagcatcatctacatgaattccaaaacatca

SEQ ID NO: 2569 - DNA, 58 bp; double-stranded, linear
aataatgccatacagtgaagaccatgcgcatcaatcgatgtctagtgtgtactacgtc

SEQ ID NO: 2570 - DNA, 250 bp; double-stranded, linear
cgtttcattagttttaaatgatccccaatactttttgtaccttcaccaactatcgttccaacactatctacagctttttctgtggtatttttaaacagcgtctatttaatgtcttatccaattagttttatctcttaatccaaatttattagtatgaaaagtccaatttttaagaattgtctaaacagattccgcaacaaaaccagctanaaaccgtccatactattggaatnaaaacgccaatgttata

SEQ ID NO: 2571 - DNA, 174 bp; double-stranded, linear
agctcctttctttctagttaatatcattnaatcttgtttttcagtgtcaaaattacctgtaaaaacaacatttttatcttttaaaatagggattacactttccacttctattttattaatctcagatattttcatatgaattttttgaaatcctgaatcgaaaagtttagttgg

SEQ ID NO: 2572 - DNA, 390 bp; double-stranded, linear
catgcggtaggtatttctaatctatggacaaatggcggatttatgccaaatggtattgttggtttcttctttgcattatcaattgtaattggttcataccaaggtgtggaactgataggtattacggcaggtgaaactaaagatcctcagaaaaatatcgttaaagcagtgaatggtgttatctggagaattttaattttctatttaggcgctatttttgttattgtttcagtgtatccttggaatcaattaggagacattggaagtccgtttgttgcaacatttgctaaaatcggtattacatttgcagctggattaattaactttgttgtantaactgcagcaatgtcaggatgnaactcagggnatttgcagtgcgagtcgtaatga

SEQ ID NO: 2573 - DNA, 50 bp; double-stranded, linear
tagagtacagaacatacgcaaggaactcggagtttactcacgggacttnt

SEQ ID NO: 2574 - DNA, 59 bp; double-stranded, linear
tacaattacaaacgcatcgtgagatgttttaagcatcaatgagaatctaactctccaag

SEQ ID NO: 2575 - DNA, 400 bp; double-stranded, linear
gacacaacgtatgacgcatgaagagttgcgtgttgacaatcaagatgatcatagccaagttagtctaaatggttacacaaaggggtctgagaaagatcaagaagcattcactaataataaggatgaggaagcagttgctgctaaaaatcctgaatcagaagaatataaagtgaatgaaaaaataaaaaaagaacataaaaactttatttttggtgaaggtgtttcangcggtaaaatattagcggcattattattcggtatgtttattgcgattttaaaccaaacattattaaatgttgntttaccaaaaattaatacggaatttaatatttctgcgtcaanagggcaaggttgatgacgggattcatgttagtaaacggtattttaataccaattacgg

SEQ ID NO: 2576 - DNA, 122 bp; double-stranded, linear
tttaaatcgtaccttaaatttgaaagtaataagacacaccaattaccttctaactctatcgatagtttcaaacaagaaatcgntagtacattcagttatttagaacgcgttgattaccagct

SEQ ID NO: 2577 - DNA, 51 bp; double-stranded, linear
cacattgaggtgcagtcataccttgtttaaatgtccaagcacgtacttctt

SEQ ID NO: 2578 - DNA, 400 bp; double-stranded, linear
aattatgactacaggtctgactcccccttgttcagatccctgtactggtgataaatctgctaaataaacatctcctcgtctaatcattcattcgttgaattagaagataaatatgtttcgttgcaatcgcatgcttcacactctatcggaaaagcttcgttcgctagggagagatttaaatcagccatttgtgaatatccttcttttaaagattgttctaagctatgacttctattttgactaaaagataacatatgagaacctccaattgattccaaaagttattaaatgacctttaattactctaatgataacaaattttatatgcactgaccatattattttaacaattcatttgttacaaaacggtggatcacccatcatggatagagtcgcgggn

SEQ ID NO: 2579 - DNA, 112 bp; double-stranded, linear
ataaaaacctaattgactcataatcttctaacggtatatcatccacaatcacagtatgattaggattatcgttagatacatctntcactgccttatctaacccctcatcacc

SEQ ID NO: 2580 - DNA, 231 bp; double-stranded, linear
catgantntaacggattcattccatatatcaattgcgtttgttattttaataatgctattttttattttaaagcccacagtaaaaactaacgataatattgccacttataagtttttcacactacaacttcgatttaagctatatttataaaaaaatgcgcctactcataacattctttggctatttaactttaataagctagggccaagtttgtcataagataagcgcac

SEQ ID NO: 2581 - DNA, 60 bp; double-stranded, linear
acttcgtaaaatttatcttgagtggttgtttctatattaagattcatttcattacactcc

SEQ ID NO: 2582 - DNA, 284 bp; double-stranded, linear
gtcaaatgctgagttctaataatgatgttggccaccatgcatacaaaaatgctaaaagagaattacgcaagattttagatagctatctcgaaaatggtaaattaaaatattacgatattatcgttacaagcaatttagctactaaacatccgtttttcgagtatgcacgttcatttgattttatcattgtttcagatatcggtttaataaacgttgatgtaaaaagctggggtgaaaaaacattttatcactttgatgtacctgatgagcatgatacaganana

SEQ ID NO: 2583 - DNA, 56 bp; double-stranded, linear
gagtcagtcgaagtttgtcgttcgacccgtagaagtgtaaaacggcattgtgaatg

SEQ ID NO: 2584 - DNA, 67 bp; double-stranded, linear
tcgactaatgtaatgtaggcattggacgtcaaatgtaatgtggggcaatccgacgagatgatggtgc

SEQ ID NO: 2585 - DNA, 52 bp; double-stranded, linear
cgtaaccgccccttgtccgggccctccaagccttttaaggggaccccccgga

SEQ ID NO: 2586 - DNA, 238 bp; double-stranded, linear
attagcaacaatgtcagataatcgataccaactaattaggcgagaagcggtttctcatggtcttagtggcctagaaattgatgtatttgatttgcattcaaataagtctagacatattagctcgttatcaggtggagaaactttccaatcgtcgcttgcantagctttagggttaagcgaaattgtacagcagcaatcaggaggtatttcactanaatcaatatttattgatgaagga

SEQ ID NO: 2587 - DNA, 50 bp; double-stranded, linear
actggaaaaaaccgcnaacacgacattgtcaaaacgacggccagtgccaa

SEQ ID NO: 2588 - DNA, 102 bp; double-stranded, linear
gngcaattataccactatatttatttcttatactccatttgatttatagttgtattaatacattgactcaaaaactaattaatcaaatatgttttttagatt

SEQ ID NO: 2589 - DNA, 50 bp; double-stranded, linear
gcataatatcggatatgcgngtgtgtcagtcncatagtcgntggattgcg

SEQ ID NO: 2590 - DNA, 50 bp; double-stranded, linear
ttanaaattgcctntccaattntaagaatcctttttccaaggtaaaaaaa

SEQ ID NO: 2591 - DNA, 200 bp; double-stranded, linear
cttcatcccttacttttaattgtcacgtcaaataatatttgtctttaactagtaataactccaaatatatttagtttgtggtgctagctataaacacaaatgantcataacactatattttgattttgttcaattgtttttatttttggataataaatgaatttgtcatttgttattctgtgattttnaattatttatat

SEQ ID NO: 2592 - DNA, 74 bp; double-stranded, linear
tgcattaatcatcttggatactctttctaccaaagtaatgattgcactaccatgacgacgaccagcaatagtat

SEQ ID NO: 2593 - DNA, 244 bp; double-stranded, linear
cacctgctcacctctattttcaaacaattatgattgaattgaatcattctaatttttgtaaagttacttgtttaatttattatatttattaactctatgataacaaaaatactgtttgtgtataacaataaattgagatactcaataatttgataatgtgaaattgatacttttcaaaatagttgaatatgacaattaatgattagttttgcnatggtgctataancaatatttagcagttatc

SEQ ID NO: 2594 - DNA, 201 bp; double-stranded, linear
atatggtatggaactaacggaagaaggcttagcatacgttaaatatgctaaagtgattttagatagtaatagcgaatacgagagaganataaaaggactttacaataagaaggtaaatataagtattaacatgcaaganagtcagtatttgtatcgctactataataagattagtgaatggttagctgaacacccatatgt

SEQ ID NO: 2595 - DNA, 156 bp; double-stranded, linear
aaaaagtattaaaaattgcaattcttaaactgttattcatattaatatttctagcaaataacattgtaaaataaagaaaaataattanagtattgcactttattgaaatttatattacgatagtaatgcagaaatttatatatgcaaaatattata

SEQ ID NO: 2596 - DNA, 62 bp; double-stranded, linear
tgatccgcaaatcgctgaacacgttcttctattggaatccctccattcacttttagctagac

SEQ ID NO: 2597 - DNA, 140 bp; double-stranded, linear
ttacctttagnttttaaaacctgaccctccaaccagcctaattggttaaatggggatccatttatataatcccaggcctaaccttccaaggaccaacctaagggattaatccccccaatggccaaagtgggatgggtaat

SEQ ID NO: 2598 - DNA, 112 bp; double-stranded, linear
attaattggggagttaaattaaaaaaaaggggttccttccaaccgganccattcccattttggattaaaaattcccgcctttgaaaaaattgtttgccgaaccgcccttaag

SEQ ID NO: 2599 - DNA, 63 bp; double-stranded, linear
ataccgcccccagttcaataagaagccctggatcagacctgaccctggtatggggggaatccc

SEQ ID NO: 2600 - DNA, 53 bp; double-stranded, linear
atactatggaatgccttaatggtggataatttcaccaaattaattttaaaaac

SEQ ID NO: 2601 - DNA, 73 bp; double-stranded, linear
aactaaaggttctaaagatacagtaaaaattgaaaataactataaaatgcgtggcgagaaaaaagatggtagt

SEQ ID NO: 2602 - DNA, 108 bp; double-stranded, linear
cggttgccagccaaaacttggcanccaaggcaattatagcaaggcacccacctaaatttgcggaccacccggaatgcggccaccaaagttggtgggaggccattttaa

SEQ ID NO: 2603 - DNA, 59 bp; double-stranded, linear
aagcttataactatttgtgtttgtgatcgagataggtttgcctgtaaaaatggccatca

SEQ ID NO: 2604 - DNA, 50 bp; double-stranded, linear
acgtccaaagggccgttcgccccagangtgctggcaaggttccacaacgn

SEQ ID NO: 2605 - DNA, 107 bp; double-stranded, linear
gtccaatgtcacattaattgattggtataagcgatcacaaggncatagtgaatattttgcaccagacggtgtacatttagagtacaaaggagtcctagctttaaaag

SEQ ID NO: 2606 - DNA, 54 bp; double-stranded, linear
gtttaaagcaatttggaaggacattggttaaaggatgggagtggcaaaatctgg

SEQ ID NO: 2607 - DNA, 366 bp; double-stranded, linear
gttttagctgaagttaatgatgaagatatcggagctatggtaattaaactagttaaacttattttcatgcttgattatgttttatttcattcaattcaaaaaagctatacaacacatatgaatgagcttaaaaattgtttcgattacatagctgaattagataatcattatgcattagcaatgtatcgtagaacgctagaatgttatactgaaccacaaattgatgattcaaatgatggcatagtattctctgagttaacacatccactcatagcagatggcagtagccaatgatttcncactatcacanaatatactgttaactggggtcgaatgcttcgggntaaatcaacattttatggaaat

SEQ ID NO: 2608 - DNA, 142 bp; double-stranded, linear
ttcttagacgtcaggtggcacttttcggggaaatgtgcgcggaacccctatttgtttatttttctaaatacattcaaatatgtatccgctcatgagacaataaccctgtataaatgcttcaataatattngaaaaaggaaga

SEQ ID NO: 2609 - DNA, 50 bp; double-stranded, linear
gggtcgtcaattganggcaggtagagcattaagtcagaattgtagtaaat

SEQ ID NO: 2610 - DNA, 51 bp; double-stranded, linear
attgggtgatgaattttgacggtattgtcaagtccagtggctaacttccgg

SEQ ID NO: 2611 - DNA, 93 bp; double-stranded, linear
acaaacttcggactgccaattacatttaccttggggggtcagaaacaatgggtgcataaaggcccgtgtttcgaaacgggaaaaagcccagca

SEQ ID NO: 2612 - DNA, 58 bp; double-stranded, linear
atgatgtttttcggctaatttttatactgaatttagtttaattaacttatgatatttt

SEQ ID NO: 2613 - DNA, 102 bp; double-stranded, linear
ttctcaccattaactatgcatactcactttacacataaatttgcttaacatgcagaacggaaataaatcattaccacatatagatcccatcatatatttana

SEQ ID NO: 2614 - DNA, 62 bp; double-stranded, linear
tgaactacaagacgcttatatcattgacgcacatttctcgcagtgaaagaaacacttgcgta

SEQ ID NO: 2615 - DNA, 120 bp; double-stranded, linear
tggagcatttcacatacattggcaacctcatggagcttatcattctaccttggggnacagatataacaacactaacgcaacatggatggtgtcgttgataactttcaatctatagaatta

SEQ ID NO: 2616 - DNA, 53 bp; double-stranded, linear
ctgtagtaaattgccagaatccgtatcaataccagtctgtgactgcgttggcc

SEQ ID NO: 2617 - DNA, 128 bp; double-stranded, linear
acatatgatatgagtatattaacgtttaaattatggatactctaaagacaggcgattttganaaatcagcaaaaagttatatgatgtaagtgggacagacatactagatgtaacacattaaccaagtg

SEQ ID NO: 2618 - DNA, 59 bp; double-stranded, linear
cctaaccgtgtgtgtatgtatacctacaaaaaaatttacattgtgacactgcgtacgtg

SEQ ID NO: 2619 - DNA, 54 bp; double-stranded, linear
gcccatggtcaatcagacacacggattgaacgttaacaatttatgactttaaca

SEQ ID NO: 2620 - DNA, 53 bp; double-stranded, linear
atcattgtcacattgagtagccgtaaaatggtcagacgatcaatgcgaactga

SEQ ID NO: 2621 - DNA, 53 bp; double-stranded, linear
ctaagtgtcgcccgaataaccgtcaatccacggagcacataggatctcccatg

SEQ ID NO: 2622 - DNA, 59 bp; double-stranded, linear
tgggaccgataatcattcgcatgaacaccttccaccgtctcttactcactacctacggc

SEQ ID NO: 2623 - DNA, 64 bp; double-stranded, linear
attaaattgttatttcgtcattaggtgacaacttgtatgtagatattttaacatattttatgct

SEQ ID NO: 2624 - DNA, 55 bp; double-stranded, linear
ccgtcccagaatatcatatgacaaatgttaagagacttgaatgatcatacacgtg

SEQ ID NO: 2625 - DNA, 66 bp; double-stranded, linear
gtggtcaccaggtacgggggatacagggggttaatcccaccttggataagtggaaaacggatttcc

SEQ ID NO: 2626 - DNA, 62 bp; double-stranded, linear
ccaccaatgggtgggggatggaataacccttaatgcggtggtacccgggtaatggtagcccc

SEQ ID NO: 2627 - DNA, 54 bp; double-stranded, linear
catgttttttcattccttgatgacgacactagaggttcccgtgttcattattaa

SEQ ID NO: 2628 - DNA, 56 bp; double-stranded, linear
ttggccaatgggcgatacaccctctcaattcgatacataactcaaggctcagtcat

SEQ ID NO: 2629 - DNA, 50 bp; double-stranded, linear
tgtcgctaggtaaccgtgcatcgttcacaggtacntatgatttcaccnga

SEQ ID NO: 2630 - DNA, 50 bp; double-stranded, linear
gaaggncccaaaccaggcgttaaaggccgattgggtttaaaccaaaggtt

SEQ ID NO: 2631 - DNA, 65 bp; double-stranded, linear
cgcgagtgtatccgtcgatatgtcgagaggaaagattgaagtgtggaagagtgttgagtaaccct

SEQ ID NO: 2632 - DNA, 53 bp; double-stranded, linear
tgaaagaactttagctagacgttcgtaaaggtcttttgacataaagctagaga

SEQ ID NO: 2633 - DNA, 53 bp; double-stranded, linear
aaaagccaaaaggaattaattaaccccggggtttaatttctaatgggaatttg

SEQ ID NO: 2634 - DNA, 68 bp; double-stranded, linear
ggtgttcacattctgaaggtttagagagttaagattatatatatataagttttggggtgatagatatg

SEQ ID NO: 2635 - DNA, 80 bp; double-stranded, linear
ccaatttcacttggtgctgccatttcggtctctcgtgtacttgtgattgaggtgccattgttcccgtagatggttcacat

SEQ ID NO: 2636 - DNA, 144 bp; double-stranded, linear
cttacacccaacttattgacttataatctattaaagtgccattttacaatctgaatcccttaatatagcaataattacaacttccgacaaatgacttgttttatgtgcgtgattcatcaatgaacatcgtaatgcgacntaata

SEQ ID NO: 2637 - DNA, 104 bp; double-stranded, linear
taattcggcaactaatatcaagatcatgatcaaatactactgccattttcttatacctcttaatgtgaaatcactgncaacacataacatcttaaaactttgac

SEQ ID NO: 2638 - DNA, 151 bp; double-stranded, linear
cattcatccgtttttttggttcatgtacataccattgttttgtacacagcgaagtcagttaaccttatatccttgtataacagttgaaatcggcaatattaaacagtactttcccaattgctttcttcctcaattgtgcgacggactgtan

SEQ ID NO: 2639 - DNA, 51 bp; double-stranded, linear
aagatcaactgaaattcatgtgttgccctttattaagatcacatggaaata

SEQ ID NO: 2640 - DNA, 52 bp; double-stranded, linear
ttagctagttggtaggacggctaccaggcacgtcatagcgcctggaggggtc

SEQ ID NO: 2641 - DNA, 53 bp; double-stranded, linear
caggcttaaacctgagttagtgccattcataattgcaatcccaagcgacggaa

SEQ ID NO: 2642 - DNA, 345 bp; double-stranded, linear
atgtttgtcatctggagcnatagaacagggttcatcatgagtcatcaacttaccttcgccgacagtgaattcagcagtaagcgccgtcagaccagaaaagagattttcttgtcccgcatggagcagattctgccatggcaaaacatggtggaagtcatcgagccgttttaccccaaggctggtaatggccggcgaccttatccgctggaaaccatgnctacgcattcactgcatgcagcattggtacaacctgagcgatggcgcgatggaagatgctctgtacgaaatcgcctccatgcgtctgtttgcccggttatccctggataagcgccttgccggnccgca

SEQ ID NO: 2643 - DNA, 75 bp; double-stranded, linear
cttatacggatgtataggtcggtccaaacatttgattttagtggagagcagcctttcacaaattatgttcaatgt

SEQ ID NO: 2644 - DNA, 57 bp; double-stranded, linear
taccggttaattaaccagggccccggtaaaaaaatccccggtattccccattccaac

SEQ ID NO: 2645 - DNA, 66 bp; double-stranded, linear
aaagcaattcgcccgataagagtagagacgaattgcttttaaggttaaaacaaagtgagttcaatt

SEQ ID NO: 2646 - DNA, 63 bp; double-stranded, linear
cagtataacttgtgacctatttagaggggcacggttggtacaatgagtctgaaaccgtatcaa

SEQ ID NO: 2647 - DNA, 208 bp; double-stranded, linear
tagaacatggaccggtattttacatcctgtacgcctaatctgttgtaagtatctttagtgaaccgttgctctggaataaccgcgattctgggcaaacagtgtgtaaaccgactntatggggatgtgtgagtaatcattgtgnactgttgattctgttctggaatcccatttcacaacacgatcttggaagtgctgtcattttagatgc

SEQ ID NO: 2648 - DNA, 150 bp; double-stranded, linear
ttttaacctaaagaatactaacactaaaagagaatgattctgtaccgctttcctttttcactcaataactttatatttagttatccttataattgtaatttatgttagttggtaaatntttacatatatgtatttgatatgcttgtaaat

SEQ ID NO: 2649 - DNA, 138 bp; double-stranded, linear
agtttaactgacatcgagtggtacacaatagcaatggttgtgtgtaaagtcctggtgacaacatatgagagtaacatttgtagtgattatcttgtactgagagaattgacatctatgnagtttatcacgtgcaaatat

SEQ ID NO: 2650 - DNA, 52 bp; double-stranded, linear
tcacaattgcaaacttctggcacgcactcatctgcgatttcacaagctacat

SEQ ID NO: 2651 - DNA, 65 bp; double-stranded, linear
gagtcaaattaaaatgcctattggccattgtgatgtataatcacttagttcacatatactatgtg

SEQ ID NO: 2652 - DNA, 67 bp; double-stranded, linear
gggcggtaattgtcaccatcacaaattgctacgttgaaacatcgaggattcaagctggacagcagag

SEQ ID NO: 2653 - DNA, 52 bp; double-stranded, linear
acacatcttatatgtcttactgatttaaggaaagaatcagtggatcaaactg

SEQ ID NO: 2654 - DNA, 261 bp; double-stranded, linear
caagctgtaaaccaagaattccagcattaaatatctctcntggtatcggttgagataaatattccgtgtgctcattaaatgtagtaatctttattgtagttcctcaacctatgacacgaatattgcacaatattagtatagacaaatatttcctttataatctcattcaattttctcctttaattatgtatcatacattgtatattctcatatagacgttttgncatattcatagcttcaatattagtgcatttatgtatt

SEQ ID NO: 2655 - DNA, 60 bp; double-stranded, linear
aatcctattagcacttataatgatcatgaaaagatgtcatcgagaatcacctagtacacg

SEQ ID NO: 2656 - DNA, 75 bp; double-stranded, linear
cgccgaaaacaataaattctcggaacatagaatttatcacataccacgcttggattatcacaatggactgagtcg

SEQ ID NO: 2657 - DNA, 202 bp; double-stranded, linear
tattaaatatgcggttgcatatatctacggcatgatttaaccgtgaaccatgaatcattttaatcgggcacgcgtaaaatgctcattgatccgcanataccactatatatctaatagcaagcgtccaggattctgtgttttataaatttaaactaactgaaacgtgtgtatcagttcactccgntcgattaccacacttcaa

SEQ ID NO: 2658 - DNA, 60 bp; double-stranded, linear
cgtacatgtgcatcatgtatctacgtcaataagatgatggggtcacatgattggaccatt

SEQ ID NO: 2659 - DNA, 207 bp; double-stranded, linear
ctaatcatgtcatgtctacaattatttggagtattgctgacgaaatgcgttgtacaactttttcattctagcaccttgcgggggcccacaaangaattggtccattctcancatcagtggggggcgcgaataatttcgaaattattctgccactcccacttcatcgattaagttgtaactctacattacatttgtcttaaaccattg

SEQ ID NO: 2660 - DNA, 54 bp; double-stranded, linear
ttaattatgtataatacttaacaagatcacctgatagatgtctaaatattatct

SEQ ID NO: 2661 - DNA, 130 bp; double-stranded, linear
attaaaaaaaaatggggtaatttccgccaaatcccgtttcccccttgccaaggccaaatttaaccacccttgccaaatnattaagccaaattttccgatatttgtttccgtaatgtttctttaattaata

SEQ ID NO: 2662 - DNA, 104 bp; double-stranded, linear
aaagtaaaaccagtctattcaaaaaggtgaaaaatggtgacgcagcgtaaataantggtctctggtagggtaaatcgcgttgtgggtttgtcacatcaggaact

SEQ ID NO: 2663 - DNA, 115 bp; double-stranded, linear
aaaaagaataaaaggactcgaaaaactcaaaacttattntagatagtcatcgtgacaagaaacaaacatttaactagactaagaaaaatgcttcgattaaaaggcagactcatca

SEQ ID NO: 2664 - DNA, 164 bp; double-stranded, linear
gcatgcgccacggtgtctcagcagagtgactgccaccttgtgtgcgcagagtctgcgcctagtacagtcagggtgaaacacnctatacgcattaggtacagtacttcctgtctccgacttgagtagaacgtgacatatctatcagcattcactcgaaaaaggga

SEQ ID NO: 2665 - DNA, 50 bp; double-stranded, linear
aattacgcaatntccctgtcttantgaaaggaattgacctgttaattcgt

SEQ ID NO: 2666 - DNA, 64 bp; double-stranded, linear
acaattcaatagaatttacccgtaacagcgttgcactgcactcaagacggctgacgtatagcac

SEQ ID NO: 2667 - DNA, 56 bp; double-stranded, linear
gtagaaccagcgacggcgcggcggctgagcaacatctgactacctatcggccgcgc

SEQ ID NO: 2668 - DNA, 50 bp; double-stranded, linear
ggatcgattgactacatgacgtggngacgcaattatacggatagtccact

SEQ ID NO: 2669 - DNA, 58 bp; double-stranded, linear
gcaagatcgaattacaatcacgacgatcaacgcacgtaatcatctctgatcacagtaa

SEQ ID NO: 2670 - DNA, 124 bp; double-stranded, linear
ataccagccagacttcgatcaacagtgttcaactgcattgcccagtaagttggatagctcgcacatagtgctacaagttaacatatacancgagtttgtatctcaagcttgaagcttgactacc

SEQ ID NO: 2671 - DNA, 54 bp; double-stranded, linear
cgcttactgcataaaagcccctaacaccggggcactacgctcgttcgccggctt

SEQ ID NO: 2672 - DNA, 51 bp; double-stranded, linear
tcagcgatttaacactaattcttctagctattctctgtatttggacgacga

SEQ ID NO: 2673 - DNA, 57 bp; double-stranded, linear
gataagttgtaccatatttcgatgcaattcaatggacaatgaggtcacctggcttgt

SEQ ID NO: 2674 - DNA, 76 bp; double-stranded, linear
tcctttggccaatttttccaagttttaacccaaacggcccgggttgggtccccaattccaatccaaaataatttta

SEQ ID NO: 2675 - DNA, 56 bp; double-stranded, linear
tccgggaaccttacccagtggccctaccctatgggttaacccaaccagtggggcca

SEQ ID NO: 2676 - DNA, 67 bp; double-stranded, linear
tgcggggtctcgtgccgccgtctgcggtggttgtttgtccggtggtgtgtcggagtctttgccagct

SEQ ID NO: 2677 - DNA, 55 bp; double-stranded, linear
ggacagaggccttgacccccccacaatcctgattcaccgtaagttgctctccccc

SEQ ID NO: 2678 - DNA, 65 bp; double-stranded, linear
aaattggggcttccatccccattccaaattattaaaaccgtttaggggccttattggcaccatgg

SEQ ID NO: 2679 - DNA, 176 bp; double-stranded, linear
attttgggattaaacccttaattaaaattggccgggaaaaggaaaaggccggttgggaaaaggccaaggaaaagaccttggganacattaaaaaccttgggccaaggccttccaaaaaccggttggtttttattttgggaaccaaattggggggccgggattgggccaaaaccttg

SEQ ID NO: 2680 - DNA, 50 bp; double-stranded, linear
gccccaaagaattcaaataaccnttcggacccggtaatggccacntaatt

SEQ ID NO: 2681 - DNA, 63 bp; double-stranded, linear
tgtgcatttattgcataacctatatatgtgtgaccgatatttagtgcgcacttcaatggtgcg

SEQ ID NO: 2682 - DNA, 62 bp; double-stranded, linear
ttatccaagcttccggatagtttcaagagaaaccaatgaaatccgttatgggaccaatgggt

SEQ ID NO: 2683 - DNA, 70 bp; double-stranded, linear
aacagcattcaagtgagttactggggtttatgcaccatcattggatatctgcacaaggaatttcaacgtg

SEQ ID NO: 2684 - DNA, 68 bp; double-stranded, linear
cttaaaattccccagtttccttccttttaaaccccatggaattatcccggccaaaaatggaccattat

SEQ ID NO: 2685 - DNA, 58 bp; double-stranded, linear
ttttaacaaaacacctagatatgttcgctgatcagagatgcctggtgaccggtgatcc

SEQ ID NO: 2686 - DNA, 87 bp; double-stranded, linear
atccatccttataggcattcatcctttaacaccaacgatttacattatggatataacgacttgagggggaacgtggggtccatccta

SEQ ID NO: 2687 - DNA, 50 bp; double-stranded, linear
atggctgggcgctttacgtggccacattaggattatggcactgaagcgta

SEQ ID NO: 2688 - DNA, 50 bp; double-stranded, linear
aacggtcgtaggcaagggactccccccnggngctanatgaactggtcgta

SEQ ID NO: 2689 - DNA, 60 bp; double-stranded, linear
gctagcatccatggctcctatgccgaagctgagtagacttaggtgacgggtgcgtgacaa

SEQ ID NO: 2690 - DNA, 146 bp; double-stranded, linear
acttaaaaaaggaagattagaaaattcataaaaaaattttgctggggattcttgatcccatgggcccatntctggatttaggttattgggttggccagccaggttagcggggcccccattcttccaggctcggtttctcccaggac

SEQ ID NO: 2691 - DNA, 53 bp; double-stranded, linear
attggtgtctagatcatttaatactaaacatacaacacgactaattccattca

SEQ ID NO: 2692 - DNA, 113 bp; double-stranded, linear
tattgaattcaaactatgtactatttcctaaataatacaataaaaacgactaccatactggccagaaatatattttatttgttacacattaatttcantcctccataatttgc

SEQ ID NO: 2693 - DNA, 54 bp; double-stranded, linear
gacttatgtccgtgttccgctgaaggcacgtcacgtaaactacccggtacagct

SEQ ID NO: 2694 - DNA, 204 bp; double-stranded, linear
cttcagcatgaagaagtcgcgtgatatacatcatatcgatatataccgattatatcatcagaacattctcctggtatcattagatagatgataatttgacacagtccacaatttgtnacaacgccgagactcaatggcatcctgtacntgatctatgccggaaaacactagtctatatgcccgcagacgtccactatatgcatc

SEQ ID NO: 2695 - DNA, 112 bp; double-stranded, linear
ataactctaatttgaattatctctcactattaaaacgcgagctgtgtaataacgaacgctgacataatcttgtattgtcgcatcattcgctggtattatcatantgcggtta

SEQ ID NO: 2696 - DNA, 148 bp; double-stranded, linear
tggcaaaattagatgtctgaatagttttatttacaagtacaaaccttgtaccattttaacgtaaacacaatttacttattgaaaagaaaataaatgtattcatgaanacacactttccatagcactcatctatagtactcaaattcag

SEQ ID NO: 2697 - DNA, 101 bp; double-stranded, linear
cctataatgctaaacttcatatatctctttggcaactatctcccttctattaccaaagttacgatagcaanacaataaagcaagcatgtcatgcttacttc

SEQ ID NO: 2698 - DNA, 131 bp; double-stranded, linear
ttgataacatttgaaaagctgctccgatatcagcaaccatttcatcgaccacaatatacgacatagtcacaaaactgattagaagacaccaattgctgattatcaaatcacaaatttaagntgagattcaa

SEQ ID NO: 2699 - DNA, 202 bp; double-stranded, linear
gatagcggttgttaatcaaacgatggtacatgcttacatgatgcgccatgtttgataacagctctctatgattacgatggaagaatggtttatttcatctcaattattcctattaaatgnaacatgccctagcaaacggatacaacacaatcacaacatcactttgaaattgttaaacctgagaaccacatacgcgnaacac

SEQ ID NO: 2700 - DNA, 56 bp; double-stranded, linear
ttcgaatttaacaaacgtatcacgccataaaggttgtatatgttgtttgtaaattc

SEQ ID NO: 2701 - DNA, 163 bp; double-stranded, linear
tattgcgggcttattagtacacgatctatatgatggtcaaacttatgtctttcatattcaagtgtgacattgtgcggtgattatatttacgcgtcgttatctacgaacgccacattaagattcgaaactgacaatcaactcataacgccatggtcctagaaan

SEQ ID NO: 2702 - DNA, 120 bp; double-stranded, linear
tanacaatcgtaatcgagtcaatgatgtgaattgcccacgtgagcgctaagaatgcgacattccacacgataaggcagtgcgcatgcgcactgacctaataacactgaggatgagtacta

SEQ ID NO: 2703 - DNA, 103 bp; double-stranded, linear
ctgcttgattaggatcgtatttatatgaagactgtgttccataatgatgtgcgttttggctgaagtcccttaaatgtacntgtgtataaatgctataatttag

SEQ ID NO: 2704 - DNA, 160 bp; double-stranded, linear
tctataacgcctctcatcgtttggtcacatattaccattattcattttatgttctcgataattgtatgcgntgtttctcactgtcatcacattgatacaactcattgtcactttatacgattcacacacctcgatacgagtgatgatatatgacaaagct

SEQ ID NO: 2705 - DNA, 116 bp; double-stranded, linear
ttattgtttaagatggttaaatgtcatcatataacanttaatttttagcaattcgatatgcctataacctataaatttcacgtcaacagaaagtgacaggcatacggatgtgtgaa

SEQ ID NO: 2706 - DNA, 229 bp; double-stranded, linear
ttacacctgcagtgtatggactatggctagatacaataattttagtcatcaanctacatcatacaaacttacgacttacacatatctgcttctanatcttctaactgattaaagctcgacatcggaagctattctaaattattatcatatatctaactaactgacctaatatatactaccataaataacccgcctcaaggttcgcatccgcatataatgcttagaagtc

SEQ ID NO: 2707 - DNA, 122 bp; double-stranded, linear
tccatatcaatcctgaaagtacacatatatcgtacaccatatggtacaatttcctatantacacatcacgcatctttcaagacacatgttaggcgctggtcggtgtatctcagaaatgcacc

SEQ ID NO: 2708 - DNA, 233 bp; double-stranded, linear
ggaacttttctgattaagtgttcacacgccaaccataacatgtattcatgcacacaattgttgctaanctcactaacaacatacgaccattttactttcaatacatatgatccgtataactcgaattcnctgcttataaatgaccattttgacgttcacaatgttaaacgattggaaattttaaagttagcatgtccacatccgagcagtaactatgccgtaccatttgtata

SEQ ID NO: 2709 - DNA, 62 bp; double-stranded, linear
ttgtacctaccaacgaggatacaatggatgtcacacgaaaattgggatatagatgtcccagt

SEQ ID NO: 2710 - DNA, 104 bp; double-stranded, linear
ctttaaaaaggataaatgattgaganaaaaacccattcgaaaatcatgctgctcatgctgtagacttatcgtttggacactcgcgtaagagcgagcagtgaaat

SEQ ID NO: 2711 - DNA, 141 bp; double-stranded, linear
gtccagaatattaatctgacacaaccattttagcnggtggattaaatatatacgacctcaccgcaagaatctctatttaacttaacctatcatgaataaactggcgcttgtgatatcatatgaagattagcgaaagatagc

SEQ ID NO: 2712 - DNA, 202 bp; double-stranded, linear
tggtattgaatagcaaaattttgacactatttgcatactcaatgatacatcatatcgttatatggatttttatggtcattaatggtaagaatttgatacggaatattggcaggtttggaaatcaaataatatgagaaattgtattaacnattagtcaagttaacgctcataaatagactcatcncgcgctataacgcttacc

SEQ ID NO: 2713 - DNA, 56 bp; double-stranded, linear
ttgaactgtctaagacttggacgctaaatgaatgcgttgatacaaacggtgaatcc

SEQ ID NO: 2714 - DNA, 70 bp; double-stranded, linear
catgaccgacatcaggtgcaaactccctcattaatctgggaaaactgtatcccggtagcttatccttgag

SEQ ID NO: 2715 - DNA, 124 bp; double-stranded, linear
cctataactactcaatattgcaattacacatcctcacttttgtcaattgtttgacaatcnaatacacgttatgcacaactccattttaacggaatggagagcacatatggacagtaaattaaat

SEQ ID NO: 2716 - DNA, 217 bp; double-stranded, linear
ggaatatgtactattatcatttgatgttattactcatattttttgtaatgaatgctatcacctacaaaaaatttacttgaaacagtaataataattaattaccacaaaccatgataaatttaatanctaatctaaaatatcgcatgttcanagccacaagatataacgcgttccgtagatggaactagatagtataaggcgccgtggagcctggcct

SEQ ID NO: 2717 - DNA, 72 bp; double-stranded, linear
atgacatacgcgcatatacatgctatcccgaactaatattgatgcgtattatgtaattggagcgaacactca

SEQ ID NO: 2718 - DNA, 139 bp; double-stranded, linear
catatcatcactatatccattgcgtaatagtgatgatattgattggcataatggtatatggcagatacgataacataacnaacacctcggataattgctattagctgcgaagttatcgtgcctgatttaacgatgtaga

SEQ ID NO: 2719 - DNA, 79 bp; double-stranded, linear
ctctatcatatctagccatatgcatgagattatcgtttatctcgacacgctcttaaaaggcgacaccggcatatgatgt

SEQ ID NO: 2720 - DNA, 53 bp; double-stranded, linear
caatcacaattgaaattacacaaatacagcccattgcatgacacagaccaatc

SEQ ID NO: 2721 - DNA, 66 bp; double-stranded, linear
cgcccgaggctaccattttaccataaagaccggtctaaatccttccggtttccatgggccatttgg

SEQ ID NO: 2722 - DNA, 169 bp; double-stranded, linear
tncctcgccgaaaatgacccagagcgctgccggcacctgtcctacgagttgcatgataaagaagacagtcataagtgcggcgacgatatcatgccccgcgcccaccggaaggagctgactgggttgaaggctctcaagggcatcggtcgacgctctcccttatgcgact

SEQ ID NO: 2723 - DNA, 54 bp; double-stranded, linear
ccgggccaagctggtgatcaccgatgtggagcgccaacatcgcatcgaggaaat

SEQ ID NO: 2724 - DNA, 54 bp; double-stranded, linear
atcggtgatcaccagcttggcccgggacaactgcagagcgtgcagcaggaattc

SEQ ID NO: 2725 - DNA, 68 bp; double-stranded, linear
aaaaccattgtccacctttagaaagcttttgttttgggaatacctaaaccgtggttaatgggcaatct

SEQ ID NO: 2726 - DNA, 50 bp; double-stranded, linear
tttaggccctgtaacngnttgccgnttggnccgtgtgtatatcgggggaa

SEQ ID NO: 2727 - DNA, 56 bp; double-stranded, linear
ggatcattaaacgtgtatcaccatccagtttgcaagacggataaactgctgcaacg

SEQ ID NO: 2728 - DNA, 70 bp; double-stranded, linear
acccatggagaattaaatttaaaaaccgtattccgggtggatgctgggtgggtaagttggccatactggg

SEQ ID NO: 2729 - DNA, 54 bp; double-stranded, linear
accaccttccccaataagctggcctaaagccccataatgggccatggtgcggcc

SEQ ID NO: 2730 - DNA, 74 bp; double-stranded, linear
tgtttggggaccttaaatggttccaaattccaaccacccaccaaaagaattccagtttccaattaagccagcca

SEQ ID NO: 2731 - DNA, 66 bp; double-stranded, linear
aagttggggattaaggccagttatggaaaggatggatggtccatttgggcttattagaagagcatt

SEQ ID NO: 2732 - DNA, 50 bp; double-stranded, linear
tttgnaaaagccngtaagagtatttgattttgttggaggccaaaccagaa

SEQ ID NO: 2733 - DNA, 102 bp; double-stranded, linear
agtaccagcggacaattcggacccaacttggcaatttgnggttttggaccaggaaataaaaatccgtgaaacggtggcaactccaaggccatattgtaaaaa

SEQ ID NO: 2734 - DNA, 111 bp; double-stranded, linear
ccaggctggcagtttttctaaaatggtggtaggaaaattanccaaaccatttaggatggcatggtcttccacggatggcggccgttaaccccaaaaaaggccattccattt

SEQ ID NO: 2735 - DNA, 56 bp; double-stranded, linear
cgtatgggatggccattctgatgacacacaacggttaggttagcaacgttgtcaaa

SEQ ID NO: 2736 - DNA, 50 bp; double-stranded, linear
caatccgggtgtgcgggcgtgtgtacaagacccgggacgattaccgacat

SEQ ID NO: 2737 - DNA, 50 bp; double-stranded, linear
taacatttattgtggagaaagtnaggtatcgtggtagtgaggattgtgtt

SEQ ID NO: 2738 - DNA, 53 bp; double-stranded, linear
taaatttaaacccgtcccggtttcccaaatttggaattttttggaacccctgt

SEQ ID NO: 2739 - DNA, 85 bp; double-stranded, linear
atacccaccttggattcttaataccccaaaaaggccggggcaacttggcttaaaaaactggcttgtttaaattggatttccggct

SEQ ID NO: 2740 - DNA, 70 bp; double-stranded, linear
ggaaagtttagtagtttagagtcgaaaaattagttttctagtgtaacgaatccggacccaaatttttttc

SEQ ID NO: 2741 - DNA, 53 bp; double-stranded, linear
cgcgccaatttacctggcgcagcagacgctcaacgaggagcacggcagctgcg

SEQ ID NO: 2742 - DNA, 60 bp; double-stranded, linear
tgaagaaatcgcacacactatcgaacgcagatcgcacatcgaatgcatcagaatcagctc

SEQ ID NO: 2743 - DNA, 125 bp; double-stranded, linear
tatcacctcttttgcatattattagaatatataatgatctttatagaaaggaaagaagaagagttatcatngcgatatcgcccagcgcgtcgtacactatgccatgaattacacaatcatgcctc

SEQ ID NO: 2744 - DNA, 59 bp; double-stranded, linear
gaatttcccccgaaaccgggaaaaatttttcccaaccggtggccttcccccgttcccgt

SEQ ID NO: 2745 - DNA, 51 bp; double-stranded, linear
ttttccttaagttagtttttttattgggccaaaaccggccccaggaattga

SEQ ID NO: 2746 - DNA, 55 bp; double-stranded, linear
taatttggtcataatgttgtttcagatgaaatgctaacaatacactgattacagt

SEQ ID NO: 2747 - DNA, 64 bp; double-stranded, linear
atggtggaatgggatttaggtggatggcccccccaaccagccggtcctttttaaggaactttgt

SEQ ID NO: 2748 - DNA, 78 bp; double-stranded, linear
aacaagagttacattggttgtggaaatcatcggttttaattagtccaaaaggatggattcaatcggtaggggggtaag

SEQ ID NO: 2749 - DNA, 54 bp; double-stranded, linear
gcaagtggcggagtcacacttatagacaagaagtacgacatcttgtatgtggtg

SEQ ID NO: 2750 - DNA, 58 bp; double-stranded, linear
tatttagattcaaagcatcaaattggtttcgtacccttttgcacatcggttgggataa

SEQ ID NO: 2751 - DNA, 79 bp; double-stranded, linear
ggaaaaccccccaaattttccccccccgttgggaaaagagttcccaaagttggaattagttcccaaacccgggagttcc

SEQ ID NO: 2752 - DNA, 68 bp; double-stranded, linear
agaaccgagagatagtgccgagagagcgagaggttttaatagagatgtttggccgtactagttagccg

SEQ ID NO: 2753 - DNA, 64 bp; double-stranded, linear
ataatctatggggggaccgtctggtaaggaacctggttgccctgccaatgaagccaccctggtt

SEQ ID NO: 2754 - DNA, 76 bp; double-stranded, linear
acaaaggttttacgcccaaattgttcactggctaactgggcgatggttagtattggcagcgcaaaagtggcagggg

SEQ ID NO: 2755 - DNA, 51 bp; double-stranded, linear
acctcagggacaattaaaagtttttcttcggaatgaatgacaacaacaaat

SEQ ID NO: 2756 - DNA, 50 bp; double-stranded, linear
acgtattccctcgttcttaggtcttctaaacataggtgactttttggtcg

SEQ ID NO: 2757 - DNA, 53 bp; double-stranded, linear
aaatgcttcgtattaacgcctattttagctccgttatagacacaacttacaca

SEQ ID NO: 2758 - DNA, 51 bp; double-stranded, linear
acacggcagcgaatactcgtttggtgagcctgtacacatctaacacgagaa

SEQ ID NO: 2759 - DNA, 115 bp; double-stranded, linear
gggaaaaccaattaaggatttaaaggttnatttaaaggggccgccaccgggttggggatgccctttgggcaccttaagaaagccccgatggaaagggaccggttaccttaaccgg

SEQ ID NO: 2760 - DNA, 227 bp; double-stranded, linear
tttggccaggccaattaattcctggtggccaattaaatttaaggggacctttgggggaataaggtttaaaattggaaaatggtccaatttggaccttttggccaattggattcccggcttaaaaagatttggaccggtaaatccctttttaaattacctcgggccanggcccaaccaagccaaaccaatttaaatccgcctggaaaccaacccatanttcctttacc

SEQ ID NO: 2761 - DNA, 59 bp; double-stranded, linear
acactattgtgccagcgcaccttcgaggtatcttgcatcactcagctgttttttactgt

SEQ ID NO: 2762 - DNA, 68 bp; double-stranded, linear
ttatcctgttcctaagcccgacggctcggccacacgattaacctttaacgccatcttgtccaacctgt

SEQ ID NO: 2763 - DNA, 116 bp; double-stranded, linear
tggaaagtaccatataagtaatggtagtcgtttcagaaagatataaatcgttgggaaaagaagaaatgacanattaatgtaaatatttgttcatgtacaaataaatataatttata

SEQ ID NO: 2764 - DNA, 78 bp; double-stranded, linear
ttgttacagtggtgtagcggatcgcacggccttcaactaagtggttcaatgcttgataccagttatgagtgttggtgc

SEQ ID NO: 2765 - DNA, 112 bp; double-stranded, linear
atatattcgtatgcaccttttgtaaggctttgtaatacgaaaattatcactacaatgattgctgtaacgagtaacgacatatatggcacaccgtttttattngttttaccaa

SEQ ID NO: 2766 - DNA, 123 bp; double-stranded, linear
tattgaagattttttcgaagataaaggtgacacatattcatgtcatgtttaatatcgttaccttacgtaaccatataagactgtaacttgtgtcatatcattcgtagaacntttggaaatgat

SEQ ID NO: 2767 - DNA, 60 bp; double-stranded, linear
gtccgcgccacggaatggcccacgggacgataagtgagggcaccgacggccgaacccaag

SEQ ID NO: 2768 - DNA, 50 bp; double-stranded, linear
gtacgcggagcacgaattccgcggatctgggagcatctctaggtaanttt

SEQ ID NO: 2769 - DNA, 53 bp; double-stranded, linear
cttaggtagctcagtgtgttattgagaggcctgttggcaggccccggacgatc

SEQ ID NO: 2770 - DNA, 69 bp; double-stranded, linear
aaattgatagcgtgcacaaaccaggtccatccacgaacatgccaatccagcccaggaagtaattgcccg

SEQ ID NO: 2771 - DNA, 52 bp; double-stranded, linear
acgatcatctggatggatatacagaacagtgtgattgtacgtggtggggaaa

SEQ ID NO: 2772 - DNA, 70 bp; double-stranded, linear
ttaacagtatgatattatcacacgtgaataggatatgccaacactggcatcgttggggatagcgtaatac

SEQ ID NO: 2773 - DNA, 67 bp; double-stranded, linear
aacattgtattcgtgattaagacttcgatcggttcagtattcggcagatccacatgtgaccatgctt

SEQ ID NO: 2774 - DNA, 120 bp; double-stranded, linear
cacccttgtgatatcacatttgtatgtgttaagagggagcccctttcccgatcaactggcgataaaaacagttganaagtgggcgggggttattatttctgatgacggcggggttttttc

SEQ ID NO: 2775 - DNA, 50 bp; double-stranded, linear
aaccgttgcaggtnaagctgggcncaccattcttctctattaatggttca

SEQ ID NO: 2776 - DNA, 57 bp; double-stranded, linear
catgtacggtgtccacacaagaagtatttaggtggttgttcccggatttaacctggc

SEQ ID NO: 2777 - DNA, 51 bp; double-stranded, linear
aacgaccccgggttccaccggggtccattaagccaagggccaggggacccc

SEQ ID NO: 2778 - DNA, 124 bp; double-stranded, linear
ttgttccggcctaaaaaatttaaattgaacccaagggttgccttgggttgggtaatccattttttgaataaacctttgnccctaatgaatttttccgccatttaaagggtgtccgccaatccgg

SEQ ID NO: 2779 - DNA, 58 bp; double-stranded, linear
gtaaatttgggaattaccggaaaattaaggaaaggccagtaaggggtttccaggccaa

SEQ ID NO: 2780 - DNA, 371 bp; double-stranded, linear
gcactccagcctgagcaccagggtgagaccctgtctcaagaacaaaaacancaacancaaaaaacttgttcaaaactcacttcctgcagtaatctttccttgaacaaactcaccctctaattcccacctgcaattgtgtgtagaaatccattctcgtgtgtaattttgggcttatatgcacacattgaaaatccaagagccagaaagagctctaaggaattatccagtccagctctgtgcttttcagataagggaactaaggcttagagaaagccagggacttacccaaggtggtagcaaagcctgggctaggacccagatctttcccatttccctgttccaaaaattttnggcacagggtggccaccctg

SEQ ID NO: 2781 - DNA, 133 bp; double-stranded, linear
ggggttgccaaaggggtgttaaatttaagtccgatgaaaattaagnaaaaaaatcccattttcccttccgggtccgttgttggggccttaatttcccgccaatccaagtttggtgaatgaaattaattaccgt

SEQ ID NO: 2782 - DNA, 58 bp; double-stranded, linear
gttcaagttgacgctggatcatctggtacacacgtatcctgcatactatagatgtcat

SEQ ID NO: 2783 - DNA, 50 bp; double-stranded, linear
gctaattataggccgtcaggcattacgngatcgaatctggcaactcacaa

SEQ ID NO: 2784 - DNA, 50 bp; double-stranded, linear
gccncnctctgtgacactgtgtatatacacccgcgggaatatctccaacg

SEQ ID NO: 2785 - DNA, 111 bp; double-stranded, linear
ctttgtctgacatattggggcagtgatttttgggacggttctacatgtcgagtactttagtcagagttgtgagtagcggacgggtntacttgatatacccttaatgtgtat

SEQ ID NO: 2786 - DNA, 50 bp; double-stranded, linear
catgatgatacttgcatgtacgttgtacgtgaacgtacagttacgttgtc

SEQ ID NO: 2787 - DNA, 52 bp; double-stranded, linear
tcagcaagtagtaaggatatcaaactatgatctatttgatgttatgccataa

SEQ ID NO: 2788 - DNA, 64 bp; double-stranded, linear
gcatcatggaatattaaaacagctgatatgtttgagtaatgattgattgacgagatatgcggca

SEQ ID NO: 2789 - DNA, 50 bp; double-stranded, linear
tgagagaagtcacagtcgccagcggcaaagaacccgnnaagatgtgngca

SEQ ID NO: 2790 - DNA, 64 bp; double-stranded, linear
cagtgtatggaatcttgtttgagtgtgagagtcaaagacttggtgattgaatggaaaaattgaa

SEQ ID NO: 2791 - DNA, 50 bp; double-stranded, linear
acaangggtgaagttctcccacatgctgtataccgtgggattatttttaa

SEQ ID NO: 2792 - DNA, 83 bp; double-stranded, linear
attcctattcaacaacggatacataatcttttatatcttccttctagtcatatgatactggaataagtgatatttcttataat

SEQ ID NO: 2793 - DNA, 64 bp; double-stranded, linear
catatgtcatcgtacgtaatcatcgatgaaatatcaacatctcgacttaataggtcaacaagat

SEQ ID NO: 2794 - DNA, 57 bp; double-stranded, linear
ccctactccgcgcaataaccgcattaccagatgcgcttccactgaggaacgacggat

SEQ ID NO: 2795 - DNA, 65 bp; double-stranded, linear
agataaagtgtcatctatatccatctatcaatatagatatgtttacggccgatttcaatccgcaa

SEQ ID NO: 2796 - DNA, 58 bp; double-stranded, linear
tatacgcctcattacacccaattggaccctttacgtatggagtacattatagaatcga

SEQ ID NO: 2797 - DNA, 50 bp; double-stranded, linear
ngctaagaatttataagaggtttcggcagatatatatacgcaagtatctg

SEQ ID NO: 2798 - DNA, 118 bp; double-stranded, linear
aagcagtctttcacaaaaagtgaataatcactagttcattaatttgcatttgaaccttcatataatgcatattacttaatgtacaagcaaagatgtatttacctatcaaagaatttnc

SEQ ID NO: 2799 - DNA, 53 bp; double-stranded, linear
ccatagaacctgtgaatacctatacatatcatactgtggaattcgttacgagg

SEQ ID NO: 2800 - DNA, 51 bp; double-stranded, linear
ccaattcagactgttattctctcttcgtgataacccgtgatgtttgtctgc

SEQ ID NO: 2801 - DNA, 50 bp; double-stranded, linear
gggggngcataccgcaccgaagcatcagacgatgtgagcgacctacctcc

SEQ ID NO: 2802 - DNA, 50 bp; double-stranded, linear
ccgtagcgcacatatgacgagaccaaggataacgtgcaangncatattgt

SEQ ID NO: 2803 - DNA, 50 bp; double-stranded, linear
cacgtcatgaacgtgcattcaacacaatcatttacgagatggaccaagac

SEQ ID NO: 2804 - DNA, 126 bp; double-stranded, linear
tatggtgtttattttagcgctngttgtgctttgtcttcagcatctataacctagtgcgatggcctgtagtatggccacttttgtaatgctcttcagttgaagtcctggttgaaagtatcactattg

SEQ ID NO: 2805 - DNA, 88 bp; double-stranded, linear
aaaagcgcatatggtgtttttctcatatcactccaggactcagcagctggaaggagttaagaagtaataaggtgccaccctaaatcca

SEQ ID NO: 2806 - DNA, 66 bp; double-stranded, linear
tggatccggtaccaaatagggactaccgggaatgtcccggggggcctaatgccgaatggggcaacg

SEQ ID NO: 2807 - DNA, 66 bp; double-stranded, linear
cccgctaacgtggggaaagttttgaagttaagaaggaatggattcctaacggggcggggtccaaac

SEQ ID NO: 2808 - DNA, 56 bp; double-stranded, linear
acaaagcagtactgaactggtttcgttggagcccgtgttgctgtttattcacggca

SEQ ID NO: 2809 - DNA, 63 bp; double-stranded, linear
agggggcgtacaacatagatttgcgagatactcagcattacacttccatttaacttattatcc

SEQ ID NO: 2810 - DNA, 58 bp; double-stranded, linear
ttaggcgcctgttccaaccgcacccatataaggcggtcggctgcacgcacgacgtatg

SEQ ID NO: 2811 - DNA, 58 bp; double-stranded, linear
aaacccccaaggaattaattttccggttttccaaccccttaaaaagggaaaggccaat

SEQ ID NO: 2812 - DNA, 72 bp; double-stranded, linear
catcattaaggcaaaaactttcacaaagtcatgaggcgcaaaaggtattattataacacatcccgcgttggg

SEQ ID NO: 2813 - DNA, 53 bp; double-stranded, linear
ccatttaaagcggtacggggcttggttcaggaacgtcgttagacaaattcggt

SEQ ID NO: 2814 - DNA, 53 bp; double-stranded, linear
tagtacccaatttccagtcgaaccaggatgggaccagaagccaaaccaacgtt

SEQ ID NO: 2815 - DNA, 62 bp; double-stranded, linear
gaaaaaaaggccttgtttaccaaaggggccaattttttcggttcaaggtccaaacctacctt

SEQ ID NO: 2816 - DNA, 50 bp; double-stranded, linear
tctgaatgacgccgaaatcccatctgaattcatgggattttccactttca

SEQ ID NO: 2817 - DNA, 51 bp; double-stranded, linear
cgttactaaagctacatagtgcgtcatttaagattatagcaagtagcatat

SEQ ID NO: 2818 - DNA, 54 bp; double-stranded, linear
cattcaccataatattcattgttccattagcatatcaggcatgtcacgtgcaca

SEQ ID NO: 2819 - DNA, 50 bp; double-stranded, linear
gtgtatcaaatgagcatgttncaatggttcancatggcgtttatggcact

SEQ ID NO: 2820 - DNA, 50 bp; double-stranded, linear
acaattgcggctgctcattgtgagcacgactttatcatggttgggttcag

SEQ ID NO: 2821 - DNA, 102 bp; double-stranded, linear
cagtagtacgtaaaaatgaatcacttgaagatgcgtacgtagattttaaacgtcagttctaaaaagtggacaatccaagagacgtaacggaatttncgaaaa

SEQ ID NO: 2822 - DNA, 55 bp; double-stranded, linear
gagtacttaatccggcaccgtttacttctgggggcatcgactaagtggggcggcc

SEQ ID NO: 2823 - DNA, 71 bp; double-stranded, linear
attggtttctcataaacacttttctatgaatttgtatgtatttgtttattaaaatctctaattcttatgga

SEQ ID NO: 2824 - DNA, 134 bp; double-stranded, linear
ccattgagtgtgagtatatcatcgatcaatatgcaacatttatcaggtgcatgttgcttatggtaatcagatggatatatcatcgtatcatttgtactgtncaacaaacgcccatatgtatggataattgaaca

SEQ ID NO: 2825 - DNA, 57 bp; double-stranded, linear
ccagaatgatgagctacaggatcagcccagatatgcaggtaaacgggccaaccattg

SEQ ID NO: 2826 - DNA, 89 bp; double-stranded, linear
caataatgctgaacagcaacgcatctcattctaaaatcgctcagaatcacatcccatgcacacataataagtggcacttagcttaaaat

SEQ ID NO: 2827 - DNA, 64 bp; double-stranded, linear
cggattagtggtgtaaactgggtgacccataccacacctcgcgtgttgtgaaaaaaggacttaa

SEQ ID NO: 2828 - DNA, 51 bp; double-stranded, linear
tatacagaaaacagcgtgccgttatccattatcacatgacatatgtagtcc

SEQ ID NO: 2829 - DNA, 68 bp; double-stranded, linear
gagatacggtcttcgtatatgatatgtgcatatttagatagtcatttatgagagaacgtggacgtgag

SEQ ID NO: 2830 - DNA, 58 bp; double-stranded, linear
tgatgattgtttatgatacgatatgtaaatgataatcatccaggaggtctagcatggt

SEQ ID NO: 2831 - DNA, 54 bp; double-stranded, linear
cctaacaaacataattaaacccataaatgcatccaatgcggttaaaccatgaaa

SEQ ID NO: 2832 - DNA, 50 bp; double-stranded, linear
caataaaaaactacacgaattttggcgtactcncttcgcaccaacgcatc

SEQ ID NO: 2833 - DNA, 69 bp; double-stranded, linear
gtctgctaccctttcagagcaacatgctgagtgtataatgccgtgtataggggacaatgccattcacta

SEQ ID NO: 2834 - DNA, 55 bp; double-stranded, linear
aacaccagctggtaagtatcacgttacattttgtgtcttcatgattaataaaaac

SEQ ID NO: 2835 - DNA, 50 bp; double-stranded, linear
agagcttggatgtcgttcgtaattgatgctctagctccatggggcccatg

SEQ ID NO: 2836 - DNA, 138 bp; double-stranded, linear
tttcgtcactattgctcatgcatagacatttgcaataccggcaaatgacgatggnatatgtgcaatgatgtcccagtccgctaaatccataggtatatgacaacctggggagatgtgcctttaatggtcaatacaggg

SEQ ID NO: 2837 - DNA, 61 bp; double-stranded, linear
gttggcaacttcagtcgctactttaacgcatctcacagtcctcctcccaaagagaacgtat

SEQ ID NO: 2838 - DNA, 78 bp; double-stranded, linear
acgtgaatcccgtgaggccaacagtgatttggataattacatggatgtttgactaatggtcattcacacccagatcag

SEQ ID NO: 2839 - DNA, 90 bp; double-stranded, linear
acttaaaatctcctcttgcctaacttccacattcttatcgatatgaatacaccatacgttttatagataagttgatgttgatgcatatgt

SEQ ID NO: 2840 - DNA, 61 bp; double-stranded, linear
tatatttagtctgttatacaaggtgtatcacagcggtaatatgcctctacatggccatatg

SEQ ID NO: 2841 - DNA, 58 bp; double-stranded, linear
gggccccggcggcagggaggaagggggcaagggcggcgccaagaccacgaccggcacc

SEQ ID NO: 2842 - DNA, 60 bp; double-stranded, linear
tgtacaggtgcagttagaccgcctgacggaacgagacgtgcaattgccagcaacgcacaa

SEQ ID NO: 2843 - DNA, 62 bp; double-stranded, linear
aaacatgtgaagtgatcgaggtatggacggagtaatgatcgcacaagacatagcatccccgt

SEQ ID NO: 2844 - DNA, 52 bp; double-stranded, linear
acgatttagtttgaatttctattagggtttggtgattctactacttctgata

SEQ ID NO: 2845 - DNA, 63 bp; double-stranded, linear
gattatcacaattatgcaaagttgtctaatcgttagaccaatttctgttcaaacaccacaatc

SEQ ID NO: 2846 - DNA, 50 bp; double-stranded, linear
cgttatataagancgacatggaagcatgatgaaatattgaatacatcata

SEQ ID NO: 2847 - DNA, 51 bp; double-stranded, linear
ccacaggtgcatccgcctggtatggagccggccagtcttcactgctttcac

SEQ ID NO: 2848 - DNA, 113 bp; double-stranded, linear
aaaactgtcccaagctgtttttatttagagcaaccaatccaatttaaaccccccaccattattttaaataataccattccagcgaaagccctttccanggttttggaatataa

SEQ ID NO: 2849 - DNA, 155 bp; double-stranded, linear
catctggaactttttaattccagaagggttccagaaggtttcgaaatccctcctaatgggctccattaacggattttaaattttttaataattttaggccaaaaaattaatttccaggaaaagtaagtttccaacccgggtaagaaattaccnaa

SEQ ID NO: 2850 - DNA, 64 bp; double-stranded, linear
cacaaactaacatagaagggccatcatcaggtgctattaaatatctacgctagattgtaaatca

SEQ ID NO: 2851 - DNA, 54 bp; double-stranded, linear
aattattcatcaatagctctttacgattcacaaatctaggtacttttcagatct

SEQ ID NO: 2852 - DNA, 58 bp; double-stranded, linear
aagcccctttaaactgggcctttaaggaacggtggcgaaaatccccaaattccgggca

SEQ ID NO: 2853 - DNA, 103 bp; double-stranded, linear
aaaggtttccattcggtcccattaagatttttttggaaattccatggaaggatggttggtcctttaggcctggtaggttatcctttttgnaggtggtatccag

SEQ ID NO: 2854 - DNA, 55 bp; double-stranded, linear
ggccacggtcattcctccaagccaaccagtggacaagatgggtggaaggcgcagg

SEQ ID NO: 2855 - DNA, 53 bp; double-stranded, linear
tatttggcattcaaataacgtaaacggattttgaagtaatttacataaagagg

SEQ ID NO: 2856 - DNA, 53 bp; double-stranded, linear
acaatttgacaatgactgggatgctgacacttgatatgaagacaattgaagat

SEQ ID NO: 2857 - DNA, 50 bp; double-stranded, linear
aactgcgttacatgctttgcttttaactgaacccagaacaacggtttcgg

SEQ ID NO: 2858 - DNA, 50 bp; double-stranded, linear
ctttnntancttcatctctattattattgtccgaattactacgtggacaa

SEQ ID NO: 2859 - DNA, 66 bp; double-stranded, linear
tccaggtcgaatttattgccaattagcctcccgggttaaaagggtgggtgtcgggtaaaatcgtac

SEQ ID NO: 2860 - DNA, 72 bp; double-stranded, linear
ggtatccagtcccccggaggggtgacaaacttccacgcccagtggggggactaccgttttggaccaaagccc

SEQ ID NO: 2861 - DNA, 58 bp; double-stranded, linear
agtgtcgaacaattaaagatattgagtgacaggattgcttaagggccggtcggaacag

SEQ ID NO: 2862 - DNA, 50 bp; double-stranded, linear
ttagcggtaaatccgaagaactaagaagacgtcaagaaggggatatacgc

SEQ ID NO: 2863 - DNA, 50 bp; double-stranded, linear
gcaaaantgagagctcaanctgcannaagcaaatcaacgaaagattaggt

SEQ ID NO: 2864 - DNA, 246 bp; double-stranded, linear
accggcacaaccatcggatcaggctttggctcaacaatgatgataacgcgatgaaaagaaaactattctggatttgtgcagtggctatggggatgagtgcgttcccctctttcatgacgcaggcgaacgccagcaacgcaaccactgatcaatgctgagccagctgtagccgcccagacggaacaaaatccgcagtgggggcaagtgatgccgggcgtgcanggcgctgatgncagttcgtggcag

SEQ ID NO: 2865 - DNA, 50 bp; double-stranded, linear
acagatgatacctcttgatcacttgccagagatcgtctaagtcgtccttg

SEQ ID NO: 2866 - DNA, 51 bp; double-stranded, linear
aataccacgctgaccttaataagccatcatgggggaaatcatgaccgcaat

SEQ ID NO: 2867 - DNA, 50 bp; double-stranded, linear
caacttggtaagtggtcgttttgggccccaccctacccgtttggacctgg

SEQ ID NO: 2868 - DNA, 223 bp; double-stranded, linear
cccaacccggttccgggccttaattttttnccttttaaaggaaaaaaaggaaaaaccggttaattccggcccaaaaancccggaagttggaaacctttttttaataaaaataatggaccgtcccaacctttgttgccaaaaggtggcctaaaggtttaaaaaaaaccgttaaaatccatggccaggatccagcctaaaattgaaaccattataattgataaac

SEQ ID NO: 2869 - DNA, 66 bp; double-stranded, linear
tggacctttggtaatatgaattgaatggtgctttgtggaaatcgggaattcgcctcgtgccttgta

SEQ ID NO: 2870 - DNA, 50 bp; double-stranded, linear
aanagccangatcatggtatatccattaagagacgagaagatcgatgccc

SEQ ID NO: 2871 - DNA, 125 bp; double-stranded, linear
ttatttggacttacaaggagaatagtcanttctaggaaagtggtgcgaaagtcacttaccaatatacggggattattcatccatcgtcggtcggtcatatgatacggaattaacacgccactccg

SEQ ID NO: 2872 - DNA, 62 bp; double-stranded, linear
caacacctgacgtgtatagaactcatctcttcaataacgtcgctgtcaggttacgaagtcga

SEQ ID NO: 2873 - DNA, 54 bp; double-stranded, linear
tatacattccatttaacaccttaacacatgcaagttacttcctcctcaagcatc

SEQ ID NO: 2874 - DNA, 56 bp; double-stranded, linear
gctgaaaggagacttctgcaggtgtgatcacaaactgcacatctacacaagccatt

SEQ ID NO: 2875 - DNA, 112 bp; double-stranded, linear
agcgcgaccgcgagaagggagggggagccagagcagcagcaggccccagggcgaaacccccaagaggagcgagnaagaaggagggaaagcccagcaggggcgcccaggccag

SEQ ID NO: 2876 - DNA, 50 bp; double-stranded, linear
gngcgttnnancggtcgcgtagagatgtcgggtctgtagtagatctgggg

SEQ ID NO: 2877 - DNA, 68 bp; double-stranded, linear
accttgactttgcagacgatgatgcttttggctgggatcttcaccatctggcaactgaatatggttgg

SEQ ID NO: 2878 - DNA, 53 bp; double-stranded, linear
ctccacctgatgcatgcccccatatcaggaaaatgataacctcggacaccttc

SEQ ID NO: 2879 - DNA, 75 bp; double-stranded, linear
gggaactttgatctgcccttgaaatcctgaaaaatgtttgcaaacgggaatgatcttgtgccttgctttgaatga

SEQ ID NO: 2880 - DNA, 341 bp; double-stranded, linear
agagaggccgagatggcagatgagattgccaaggctcaggtcgctcggcctggtggcgacacgatcttcgggaagatcatccgcaagaaataccagccaaaatcatttttgaggatgaccggtgccttgctttccatgacatttcccctcaagcaccaacacattttctggtgatacccaagaaacatatatcccagatttctgtggcagaagatgatgatgaaagtcttcttggacacttaatgattgttggcaagaaatgtgctgcggatctgggcctgaataaggttatcganggtggtgantgaagttcagnggtggacatccgtctatcacgttca

SEQ ID NO: 2881 - DNA, 50 bp; double-stranded, linear
gcggttactgtgtaatggcattaaatatgaaacgagccgatggagcgttg

SEQ ID NO: 2882 - DNA, 81 bp; double-stranded, linear
ctcatcatttgtagttggaaaggtttatgtacatttggaaaacaccgacacatgacgtatctccattgcaatttacacaag

SEQ ID NO: 2883 - DNA, 77 bp; double-stranded, linear
ttttttttttttttttttttttttttttttttttttttttttttttttttttttttttttttttttttttttttttt

SEQ ID NO: 2884 - DNA, 104 bp; double-stranded, linear
acggtgtgcttgatgcacttggaactgtgagtttgggtgtgactttgctttggcttgcttgctgaatgttttgactatgcattgcgtatatgacttgnagcgcg

SEQ ID NO: 2885 - DNA, 127 bp; double-stranded, linear
agcaacgtgtctgtcaacgtggtgtcattggaaaaggcgtcatgtattgnccggtgggatttacgtgtagtcacacatgtgcccaattattgttttgaggccaacttgagtaggttgatggttatgt

SEQ ID NO: 2886 - DNA, 51 bp; double-stranded, linear
tgagcgagtgctgtgtgagcgcgaggttgtgagagttagaaccttgtgagc

SEQ ID NO: 2887 - DNA, 63 bp; double-stranded, linear
ttgaaaccgcgaacctgagttctggttaactacagtctggtatacacattgagggaaacttcg

SEQ ID NO: 2888 - DNA, 50 bp; double-stranded, linear
agtancatacncaactatctcagcatacaatattggncacctcgcagctt

SEQ ID NO: 2889 - DNA, 115 bp; double-stranded, linear
aaanataatcccggttttatccccctacctaattagtgggaaaagtaccaattgccaattggtaaaataggttgccataacggcctcccaaaagtaaattcccttttttggttta

SEQ ID NO: 2890 - DNA, 147 bp; double-stranded, linear
aatcggtccgttatactcttcataatattgtggcgcaaccatttcaactttatcttttcttataaatagcatcatcgcaatantaaagaataatatcggaatgattaaagtaacgataagtaaaactaaaggaatcgttacaattgc

SEQ ID NO: 2891 - DNA, 400 bp; double-stranded, linear
aacacaacaagttgttaaagatgcatttttatcacaacataaatctattggacgtaaagctcaagaagcatacttatcatatcgtttagaacaagagtatagtaaagatgatatcttccaagtatatctaaacaaaatttactattctgatggcgtaacaggtattaaagctgctgctaagtattactttaataaagatttaaaagatttaaacttagcggaagaagcttatttagccggtttacctcaggttccaaacaactataatatttatgatcatccaaaagctgctgaagatcgtaaaancactgttttatacttaatgcattatcataaacgcattacagataaacagtgggaagatgctaagaaaatcgatttaaaagcgaacttagtaaat

SEQ ID NO: 2892 - DNA, 149 bp; double-stranded, linear
cctaattaaacctccatccatccttttgaagggggatctttaataaanccggaaagtttgggggaaaaatcctccatcctttgaaggggggggctttccaatggcctttaagaatggccttttccaagccaacttttaattcccccggt

SEQ ID NO: 2893 - DNA, 130 bp; double-stranded, linear
gcccgaagtattcttgtaagtattatgatactcggtnctttttatgatttatgttaatttcaatggaagttgtggctactaattaaacaactagtgtcattaacaaaatgtagtctttaattatgttagt

SEQ ID NO: 2894 - DNA, 65 bp; double-stranded, linear
gatgagacctgaattgattgcaacccaaatcggcatatgcaaattgcattaaagttggttcaacg

SEQ ID NO: 2895 - DNA, 102 bp; double-stranded, linear
cgcacaacacatttagcgactcagatgtcgcgcgaatggaccgatatggcgtgtctacacattgtcatattgtacgaatagatgagaaattncaaagaccga

SEQ ID NO: 2896 - DNA, 69 bp; double-stranded, linear
attaagtgatgggctaatgtttacgccccaaccaaaggtttccaaagagcccttgttgggcctgtgttg

SEQ ID NO: 2897 - DNA, 80 bp; double-stranded, linear
attgaattaatgtcccaaccaaacgaatggttgccctttttccatccaaagggggctaattgggaagggtattggttccc

SEQ ID NO: 2898 - DNA, 53 bp; double-stranded, linear
caaatcctggagatgagcgtaaccaaaaataacgttgagaaaatgaccacaca

SEQ ID NO: 2899 - DNA, 51 bp; double-stranded, linear
atcgtgaacctctcatccaatcactcatgtgagtgaattggatgacctgaa

SEQ ID NO: 2900 - DNA, 52 bp; double-stranded, linear
agctttcagggctatatcagacccacgcattcatccacgtgaatgaaacacg

SEQ ID NO: 2901 - DNA, 50 bp; double-stranded, linear
ggtactgacagagggacaaggtggaaaggntgccaatgtaagaatacggt

SEQ ID NO: 2902 - DNA, 72 bp; double-stranded, linear
tgtctggaattcaggtgaattgatgcggagatttaggtgattaaggagtgttgattatgaagatgaccactt

SEQ ID NO: 2903 - DNA, 50 bp; double-stranded, linear
catgccaaagcagtaggcaagccgcttagcaagccaaaaacgtcagccca

SEQ ID NO: 2904 - DNA, 58 bp; double-stranded, linear
ttgatgttacctgatcgcaatcttgaccacctggcagggtctcattgttgggtatcga

SEQ ID NO: 2905 - DNA, 69 bp; double-stranded, linear
accatccggtatggcacctgtcatatttgcaaaacaataaacggtcgcctgctactggttgcggtctat

SEQ ID NO: 2906 - DNA, 53 bp; double-stranded, linear
attccattaggttcaattaaaaattaacggggttatggttccggtaattcggg

SEQ ID NO: 2907 - DNA, 57 bp; double-stranded, linear
aaagctaagaaaggaggattagctggtagtggaggaatgttaagtgaggctggtgat

SEQ ID NO: 2908 - DNA, 86 bp; double-stranded, linear
gggaatggcgcatgaacgtgcacatcaaatgacactgcaggaaatcaattagcacggatatggcataaagacaatggtaaaagtgg

SEQ ID NO: 2909 - DNA, 50 bp; double-stranded, linear
cgagcaactcaagattagaaaagtagaaaaagccattantcatatgtttt

SEQ ID NO: 2910 - DNA, 109 bp; double-stranded, linear
gaatttgttccgaggtatcgaggactacgcttataaggtgcttacagatacatttancattaatggcgtgtgctgctgtatgggttatactgttcacaggtttaagaga

SEQ ID NO: 2911 - DNA, 60 bp; double-stranded, linear
ttgtccccatagggagaaataattccgcctgggcaaaaccaaatccacgagcttctaagg

SEQ ID NO: 2912 - DNA, 55 bp; double-stranded, linear
tagatgtatccagctgacattagctattggtaaggtaacggcttaccaggcaacg

SEQ ID NO: 2913 - DNA, 123 bp; double-stranded, linear
gccatgaggcccacccatccatgtttatggatggtggattggggaattacttgtttcaaaaaatccatatttaatacccctngggagggaattttaccctacctaaaatatttgaccccatca

SEQ ID NO: 2914 - DNA, 58 bp; double-stranded, linear
atccgtaattctggcctaccaagggtttaggccaatgggccattcttttatttaaccc

SEQ ID NO: 2915 - DNA, 50 bp; double-stranded, linear
tggtgcgacagtggtaggctttttacggtntgcnggcgagagttctgtag

SEQ ID NO: 2916 - DNA, 68 bp; double-stranded, linear
ctgttacgctatgccccccagttgtatgttgagtggaatcgtgtttttcgacctgcctttgctttttt

SEQ ID NO: 2917 - DNA, 65 bp; double-stranded, linear
ccttttggggccaaccttgggtccccgtttccggttttttttaaccaaaacggttccggtggaaa

SEQ ID NO: 2918 - DNA, 101 bp; double-stranded, linear
aaattccaatcctgggaatgggattccatggtnttcggaaaaatccgccaccccaaaaaaataaatgggtcccttcccttggaaatattacctttaccagg

SEQ ID NO: 2919 - DNA, 75 bp; double-stranded, linear
taataaatccatgaccaccgtcacgacgatctgactgataaactaatgacatatgactggtgtacacaccgtatg

SEQ ID NO: 2920 - DNA, 56 bp; double-stranded, linear
cttggattgaccatcattagttttggtcactctaagttgtactgtccgttgtacaa

SEQ ID NO: 2921 - DNA, 65 bp; double-stranded, linear
gctcattgcttgtatattaatccctgaaattgaccgtgtatatcccgtcgatctatcttgtcctg

SEQ ID NO: 2922 - DNA, 50 bp; double-stranded, linear
gcaatattctaatctgtatgttacagcacatggatatagcacatccgggc

SEQ ID NO: 2923 - DNA, 54 bp; double-stranded, linear
tgtgatttaacaggattacacaggtgtaccagccgatagttgattaagcttctt

SEQ ID NO: 2924 - DNA, 50 bp; double-stranded, linear
atcctgggaagtgctgaaaaaccactncactaaaggcatagganccacac

SEQ ID NO: 2925 - DNA, 52 bp; double-stranded, linear
tattaaaagggatgttaaatttggggaggataccaaggtctcaatgccagaa

SEQ ID NO: 2926 - DNA, 62 bp; double-stranded, linear
ttggtcacatttattctcgtgttgtgccgttcttcttcagtactaaagacaaggtgattcgg

SEQ ID NO: 2927 - DNA, 56 bp; double-stranded, linear
caaaaggctatcccacctgatttgcaaaaggaactggactgcaagggaagtctcag

SEQ ID NO: 2928 - DNA, 400 bp; double-stranded, linear
tgatcttgctatttagttgcggcttggattcatttggcatggttaagattaaattagatgcttcattcattcaagatttcttcatgttagcattctttacgacaatcggtcttggtgcatcattgaaattatttaaattaggtggcaaagtcttgctattatactttatgttttgtgctatcatttcagtcattcaaaacatagttggtgtatcactagcaaaagtattaaatattaaacctttgttaggattaacagcaggttccatgtctatggaaggcggtcatggtaatgctgctgcttatggtaagacaattcaagatttaggtattgattcggcactgacagcggctcttgcagctgcaactttaggtcttgtatttggagggctatcggtggt

SEQ ID NO: 2929 - DNA, 400 bp; double-stranded, linear
ctgaaccgatggcgcactttgctacgccacctacagcagatcccanggggggngaagcttatactgaagctctacgttcaacatttttccattggggattccatgcttgggctgtttatggtgttgttgcgttacgtttggcatattcgcaattccgtaaaggtgaaccaggtttattatctagaactttacgtcctcttttaggtgataaagtagaaggtcctattgggatttttattgacgttttatctgtatttgcgacaatcgttggggtagccgtttcgttaggtatgggtgctctacaaattaatggtggtttacattacttgttcaatgttccaaacaatacgtttgtacaagcgattatcatcattgttgttactatcttatttatagcaag

SEQ ID NO: 2930 - DNA, 400 bp; double-stranded, linear
atgtagatctatatgatgactttttacaagatccatcatctgtaccagaagatttaaagtcttattcagcacaattaagaatgatgactcaattgtaccagctttaaaaagtacaagtagtcanaatagcgacggcacaattaagcgtgtcatgcgtttaattgataatattcgccaatacgggcatcttaaagccgatatttatcctgtaaatcctccaaaaaggaaacatgtacctaaattagagattgaagactttgatttagatcaacagactttggaaggtatatcagcaggaattgtttcagatcactttgccgacatttatgataatgcctatgangcaattttaagaatggaaaaacgttacaaaggnccattgcatttgagtataccntat

SEQ ID NO: 2931 - DNA, 400 bp; double-stranded, linear
ggttatacaatctagaatcgcatgataatttaatgctacaaatcgatagtacaatatatctaccgtgaataactgtgcaaatagtgacgttgtagccgccatacgcatttcattttcatcagttctgccataaatcaatgcatagtctgcaatttgagccactggattattagctgtactagatatagttatgatgggaatactgtaatgtgtggccacctgtgcaattgactgcaattcactatggactaccttggattcgtcacaaaaatcatgcaatctctatcatcatgcgtcgcaaatgttgacacaagtgaaatgcgtttccatgtaataacctgacatttgaagccatacgagataactttggaaaaagatcaccaatagnccaactcgatgg

SEQ ID NO: 2932 - DNA, 392 bp; double-stranded, linear
ctttcagtagcagctacaattgtctttaacatttaagtttaaagctgtatgtgtcaaccgcaaataccgatagccattcactaatgaagtttcaactaatttagtacgatctgacaataactttttgtaatcttgggctgcttcagctgatacagcaatatttctcattgttttaacagcttcttcaggatataaaccagcagcagtttcaccagataacattactgcatctgtaccatcatagattgcgttggcaacgtcactagcttctgcacgtgtagcacgtgggttacgttgcatagaatctaacatttgtgtagctgtaataactggtttacctaatttgtnacattgtctgattaaatctttttgaaccattgggactttntcag

SEQ ID NO: 2933 - DNA, 400 bp; double-stranded, linear
tgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaagtattaacagcgagtattagaatatgacgagtattcaagaaatttgatcaaatgatggattggctagcaggtgtttacattaactcattaaatgttattcactacatgcacgataaatacagctatgaacgtaattgaaatggcattacatgatacanaaattgtacgtacaatggcaacaggtatcgctggtttatcagtagcagcggactcattatctgcattnaatatgcacaagttnaaacc

SEQ ID NO: 2934 - DNA, 400 bp; double-stranded, linear
aaaatatgccatgactggcatgacaagaattggacgttagaagcatctcaaactggtacgttcagaggtcgtaactntaacttcaatggtgaaggattctcacgtcaaacatttaaagtaaatgccgttagtcaaaaagactacgacaaatgggtgaaagaagttaaaggtaaganaacgttagatcaagatacatttgataaacaattattaccaagcacacctaataaagctttagaatttaatggtacacatatggcgtttgttgatccagcagccgatccagaatacatcttctatgcatataaacgtttcaatttcggattgaaggtcccaaacttcactagtgaggaaaatatgtttaaggtgtatcagacaaacccttaatacctgctcgtga

SEQ ID NO: 2935 - DNA, 400 bp; double-stranded, linear
atggagtatacaactacttcggcattggcgcttacgacaacaatcctaactacgcaatgacgtttgcaaggaataaaggttrgacatctccagcaaaagcaatcatgggcggtgctagcttcgtaagaaaggattacatcaataaaggtcaaaacacattgtaccgaattagatggaatcctaagaatccagctacccaccaatacgctactgctatagagggtgccaacatcaagcaagtacaatcgctaagttatataaacaaatcggcttaaaaggtatctacttcacaaggggtaaatataaataaagaggtgtgtaaatgtaccaaataaaagatgtgaaacgagaattaaaaatgatggtgttgacttaggtgacatttggctgtcgttttaca

SEQ ID NO: 2936 - DNA, 400 bp; double-stranded, linear
aaacaatacaaacaaaagaaagtcaaccaaggatggattcctattttaatccttggttgactcttattttatttaaattgtagaacctagaaaataaagtttaattaaaagcaccaatcatttctactttgaaatctaaggtttctaaaatagcaatgactttctttatatcggttgtaattgcagaatcagcctgaacgaaaaatcgatacatacctaattgtgtttttaaaggacgagactcaatccagggtaaattaatattaaacaaagcaaatgtattaagcacacttgctaacaacccgggttatcatgcattggtgtaattaaaaacatcaatggtgtcgcattttgatcaaatgctgctgattttttataactaaaaacgtgtcaggtatgt

SEQ ID NO: 2937 - DNA, 400 bp; double-stranded, linear
ttattatcttgatacattgagtgtatattccattttccatgaggcgttaaataacgcataccaaagcatctgtaccacctttaattttcttatctctattcccaaataccattggcggcaatgtcggtttatatactggtaagctctccccaaattgttggaaaacttcgtgatccacataataactttggacgtcctgttaatgttctaaaaggtactagacgttctatattcgttgtaaatggtggaatatcgtcgaccttgtttatttgaaccggggaatactgctgtcggtattacttctcgtggttgtggaagttatatttaaaaacggaaattttctcagcagcgntttcgttaggaaatatcttttaacgggcattccagtttgttcntcggg

SEQ ID NO: 2938 - DNA, 400 bp; double-stranded, linear
tatctcttaaagccggtgatggtggtaatggtattaccgcatacagaagagaaaaatatgtaccatttggtggaccagctggcggtgacggtggtaaaggtgcttcagtcgtatttgaagtggatgaaggtttaagaacgttattagattttagatatcaacgtcattttaaagcaagcaaaggtgaaaatggccaaagtagtaatatgcatggtaaaaatgcggaagatttagtattaaaagttccacctggtacaattattaaaaatgttgaaacagacgaggtttagcagatcttgttgaagatggtcaaagagctgtagtagcgagggcggtcgaggtggccnaggtaattcacgttttgcaacacctaggaaaccctggcacctggacttcatgg

SEQ ID NO: 2939 - DNA, 384 bp; double-stranded, linear
ctaacctcgagttcgtattatgcccaccacatgtctgctggcttgtcgtaaatattaacagatttcaaagtttgacaagctttttggaaaccttcttctactgacataataggatcttcatgttcaatacttaatacataatcatatccattaataataagttgacttatgatatctgcccatacatatggactatgtcctaagccaactgtacggaatgtcatgctcttgtcgcaacgttaccatatggttgcatatcagttagaccatacatatttacattttcttggattaatatacgtatctttagcatggaagtgatgaattgcatttgcttggnctaatatgcgaatcgcagccaattgggtcaatancntggccacc

SEQ ID NO: 2940 - DNA, 400 bp; double-stranded, linear
tttcatatttttctattaatgattcatattgtagggtgattgcaatgtcatctaagccatttacaagtttattcttccaagtttcatcaatttcaaaatggaaacgcttgtctggtgatgacacagtttgatttggtaaatcgacctcaatttcaacatattgtgcaagatgttcacgggcacttttttctaaaacgataggcaacatcgcatttttagtgcaattcatataaaatatgtcactgaaacttcctgcaataataatatgaaaaccatagtccttaagagcccaagcagcatgttcacgacttgaaccacatccaaaattatctccagtnattaaatnggaggcccctttatattgtggtttgttagggttgaatcagggtttntnggaacc

SEQ ID NO: 2941 - DNA, 409 bp; double-stranded, linear
atcataatccatcgtgcgtccaagaagtacttgattatttaaagtttgtattgtgaatcctgtgcacattgttctcactcctctgtaccttcatttactttaatcactttcaaataaagctgtttcacttaaacatactataaaaaatcaattatacaagcaattaattgatattcattctcaataactgtggtatgatatgtaaggaaatcatgacttatgtgtgagtgaacgatcatctatacatccgttcacttcatctcatgactttctatatttaatttttacaagggagtgacatctgtgaataacacacaatcttcaccacgcgtaatattattattgcgattatgttgtctgcataacatatggttgttgcacaatcattattantataggacctccgttg

SEQ ID NO: 2942 - DNA, 400 bp; double-stranded, linear
atgaagtgtcaaaaggtttaaaaacatctgaaaggggttcgcacatgttttaaactttaaaaataaaggtggatgtccaaaatgtcgaccagcaatcaactattatttaaacatggtttatccacatgatcatgaagatgaaagagaatcaagatttgctaacgaacgttaccatgcgaatattcaaaatgatggtacattttctgttatacctcaaatgcgtgggggtgttacagatgcagaccaactgattcgtctaggagaagtggctaagaaatatcatgtgccactagttaaagtgacaggttcacaacgtgttggtttgtatggagttaaaaaagaagattaccaaatatatgggnagcctaggtatgcgtcagcatcagcttatggtaaggaa

SEQ ID NO: 2943 - DNA, 400 bp; double-stranded, linear
acctggaaatgtatgtgccatctctttaagccaatcagtatcttgaatacctttcgttccaactatgcaataattaatccctgcggcaaagtagtccatgattgtgacttcgtacgaatgccaccacctacttcaatatctttggttgttaatctcctcaatgacttaatataatcaaactctcgggcatgctgtgccttagcactcatcaagtcgacgatatgaatacgattcacacattcaaattgactatagtaagcaatactttcttcagccgagcgtggacattttttcttcactatcatatttaccctctgttaacctcacacttgttgacccaatcaaatcaatcgctgggccataattcaatcatttnataaatcccccttgtattggcctg

SEQ ID NO: 2944 - DNA, 400 bp; double-stranded, linear
aacaaaaggggtctatcgtcaatcgtttcttgaatagtgttgaaaaaatcggaaataaattgccagatcctagcgtcttattctttttaatgtgtgtgggcttagccattatgacatgggttatctcattatttaatgtatctgttaagcatccaggtacgcatcaaaccatttatattaaaaatataattagccatgatggatttacgatgataatgaatgatacgattaaaaatttctcagagttcccagcattaggcttagtactagcagtgatgattggtattggtgttgcagagaaaacaggatacttcgataagttaatgatttctgttgtgaatcgcgcaccacgtttctaaatttaccgctataatattaatgggnattttagggagtcaga

SEQ ID NO: 2945 - DNA, 400 bp; double-stranded, linear
attttacaagtaacggtgcatcaccagattctaatttaatgtcatgctcagcagcattttgataacccaacttttcaaagtagtcaaaacaatggtctacaacaaccgtactatactcttgtgctttggccgctcttctactgcttgaaccaagccacgacctaatttttgtccacgtaattcaggatgaactgataaagaggcaatcgccaaaccataatacgtcttatcatcactattaatttctacttcaattaataaaacgtgtccaacgacatcgttattttcatttttcgctattacttctaattcaaaattatagcaaggagattttcttaaatggtttactttcggcacgtgcctggccaactcgttttcaggattatcatccaaactttcc

SEQ ID NO: 2946 - DNA, 400 bp; double-stranded, linear
ggaaataattacttgagctagataagttgacagctgtgcaattattttcagcagctaattgtaaaattcgctctaatcttgctgatgaatgttcaggcccttgaccctcatatgcatgaggtaagaataatgttaatcctgaacgttctccccattttgagcgagaactgaataagaagttgtcaaaaatcatttgtgacatatttggcaaaatcaccatattgtgcttcccaaatattgaagctttttttgttttccacattatagccgtattcaaaaccaactactgctgcttctgaagcggagaattgtgtatatcaaatgtcgctttttgancaggagcatgatgtaaaggtgtatatgttncaccngtttgctcatcatgtnacacggcagccgt

SEQ ID NO: 2947 - DNA, 400 bp; double-stranded, linear
aagtggcataaaaaaatcacatgacgatacattgtcgtcatatgactttaaatattattcttctaatgctctatgtgaagcatttactcgaccttgtttatcaatttcagtaatcttaacttcaattgtgtcaccgatttttaatacatcttccactttttcaattctattttttgaaatttgtgaaatgtgaagcaacgcatctttacctgggaataggcctacaaacgcaccgtatttttcaatacgtttaacagtggcttggataagtttgacctacttccgcttcacgtgtaatttcctcaatgatttcacgagcacgatttatcatagcttgatcaacagcacccataaagatagtaccatcctggnccatatcnaatttaacaccnggntcctc

SEQ ID NO: 2948 - DNA, 400 bp; double-stranded, linear
tttttcaagttttgctgaaggctttacacaaggctatttaacaatggatgccattgcagcaattgctttttcaatgattgttgttaatgcagtaaaactaacaggcattactaaaacaaatcaaatattcaaacaaactttgactgctggtttaattgcagccgtagctttaattttcatatatatttcattaggttatattggtaatcatatgccagtaagtgacatgacgttagatcaattgaaatccaaagatcgaaacattgggacatatttattaacgacaatggcttcaacaggatttggtcatccggaaaatattattgggcatcattgtggcgctggcatgctaactacagcatgcgggctatggtgcagttcctgaatattccatagatcg

SEQ ID NO: 2949 - DNA, 400 bp; double-stranded, linear
catggcttcagattgtttgaattgaatggacaattttggnttctgtccaaaattcttacaaaatcttctaccgataaactatcaagttcaactctaatcggaaaaacgaccttgcaattctggtatcaagtcactcggcttagatacatggnaagctccagcacctataaacagcatatgttcagtattcacagtaccatatttggtttgaataacgctaccttcaagtataggtaaaatatctctttgaacaccttgtcttgagacatcttgaccactattatgattattcgtcgcaactttgtcgatttcatctataaagatgatacccatttgttctgctaattcaagcgcttcttggttagcgctttcttgatcanttagttcatccgcataacta

SEQ ID NO: 2950 - DNA, 400 bp; double-stranded, linear
ttgactttgtaactaaactactcactcgaccgactcaactgtttaaatgtttcagatggtttaactctaaatactacgtataaatcaccagcaggtcctccattcacgcctggagagccttcaccagctaatctaatttgttgttcattgtcgacaccttcaggtactttcacttctaatttaactgttttattttcagtaccttttccgtgacatgttggacaagcttcttcaaattcttgaccacttccattacatttaggacaaacttgttcagtacgaactctacctaaaattgtgttttgttctacagctacatgaccagcgccattacagtaactacaagtctttttacttgttccaggctttgcaccatcaccatgacatgtttcgcatgtna

SEQ ID NO: 2951 - DNA, 400 bp; double-stranded, linear
caatgattttaaaagatgcaataaaaccaaacttagtacaatcaattgaagggacacctgcattagttcatggtggaccatttgcgaatatcgcacacggttgtaactcaattttagcaactgaaacagcacgtgatttagctgatatcgttgtaacggaagctggatttggttcagacttaggcgctgaaaaattcatggacattaaagcgcgtgaacaggatttgatccggcagctgtcgttgttgttgcgacaattcgtgcgttaaaaatgcatggtggtgtagcgaaagataatttaaaagaagaaaatgtagaagcagtaaaaagcaggaatggttaatttagagcgtcatgttaataatattaacaattccgtgtaganccggttgttgccata

SEQ ID NO: 2952 - DNA, 400 bp; double-stranded, linear
tcaagtagcaaaagaaacaggtgcttcagttatcggtattgatattggtccacaagccgttgacctagggcgcagaatcgttaacgtcttagcaccaaatgaagatataacaattacggatcaaaaggtatctgaacttaaagatatcaaagatgtgacgcatatcatattcagccgacaattcctttaaagtacagcattttagaagaattatatgatttaacaaatgaaaatgtccgtagttgcaatgcgctttggtgatggcatcaaagcaatatttaattatccgaagaaacagcggaagataagtgggccatgtgtgaataaacatatgagaccacagcaaatttttgatatagcacttnatnaaanagccggctataaagtnggtattacggat

SEQ ID NO: 2953 - DNA, 400 bp; double-stranded, linear
cgcaattcacaataacattaaataatttttggtctcatattttcaaaaaacatactgttattatcccatgggnttaaaaatatcattagtatataaacgaaacactttacgataaatgatatctgcaagccaagctgttacaaatggtacaacaaagaacgctactacaattagtaagacactcaaccaagcagaatcaacctccataaatttaaatgcattaatcggtcctaccattcctataaaaccaaatccagctgactctttcgttccatgaatacctactaatgctgataccaaacctgatacaatggctgtcgtangggcggggngcataagaattggatatttcaccatattaggtatcatcattttaacgcctccaaagaagaccggataa

SEQ ID NO: 2954 - DNA, 400 bp; double-stranded, linear
atattggttctcaaggtattgtgcaaggtacttatgagacatttgccgagctaggtaatcaacactttaatggagatttagcaggcactgttacactgacagcaggtttaggtggtatgggtggtgcgcaaccgttagcaattactatgaatcatggggtagcaatttgcgtggatgttgatgaaacacgtgttgataagcgaattgatacgaaatactgtgatgttaaaacagctgatttagatgaagcattaaaattagcagaagaggcgaaagaacgtgggagaaggattatcaatcgggttaatttggaaatgctgtagacatcccatccaagcggattctaggaaaaagggttttaaaattggacattaattactggncccaaaccaagtgcccc

SEQ ID NO: 2955 - DNA, 400 bp; double-stranded, linear
ttcagaatacgagcaatgtcagttgcagtgtttaataaattttgttcgctattttgtaggcatcttctaaagtgctaggtgaagagattatagaataggcactatcaataccgaaatcgtaaacatgttgataattttcgcctagactgccacaaatcgcgatgacaggaatatgatattgttttgcagctaacgcaacgcctacgggtgttttaccaaagatggtctgataatccatgcgtccttctccagtaataacgaggtctgcatctttaattctttgatgaaaatctgtaatgtcaaagacgacatcaataccttttgttaaagttgtctcacaaaacgntaataatgctgcggccataccgncagtgcaccagaacctggtatttggttnacg

SEQ ID NO: 2956 - DNA, 400 bp; double-stranded, linear
aatacgtcctttatataatgttaataaccagttaaacaatttcacaccagttggaataccaatcagcattgttgaaattgagaagaatgagttgattaacgcaccattacccattgtgaagaaatggtgaacccaaactaagaaactaaggaacgcgataccggcagttgcccataccatactttgatgtccgaataaacgcttacgagcgaatgtcggggataatttctgagtaaataccaaatgctggaaggataacgatataaacttcaggtgcccccatacccagaagaagttagcccaaagcattgggcataccgccatgtggcactgtggaagaatgctgtgtccaatattccgntcattggtncattaatggctaacgctaacggtttaaagg

SEQ ID NO: 2957 - DNA, 394 bp; double-stranded, linear
tagtaattaatacgatgtcagcacctactgattttgctttgtctgctaataatcttaaatgttccgtggacctgaaccagagataattacaaatacatcattcgacttaatcgcaggtgtcgttgattctccaacaacatgtgcctgtttgccgagctgatttaagcgcattgcaaaactattcgccacgaatcctggaacgtcctttgccagctacaaatatatgttcagcatgtagtattttgggatgcaaaagttggaaaactccatccgnttcaacatgtgacaaagtcatctttgaattcatctaganttaattgatagtcactaantttagccatattacttaccttcggttgccagcgcgaccattgtttcgcagcttcttactggg

SEQ ID NO: 2958 - DNA, 400 bp; double-stranded, linear
aattattctacctataattaaaaatgctggcaaaggtgtaatgatgatgagtaatgaacctacaacatttaatatcaatcctacataagtaattttgacgcgaccaaatttatcagcaacatcaccagcacctacgataaacaaaccagcaaataaggcagataagctaacagcgattatttatcgttccaacgtcactactatatgttgattgtaatgggacaacaagattaacaagtgactgcgcgaatagccaaaaggtaataacccctaaaacgatacccaaangcaatcggttgttcacctcttaaattgttttgatgtgtccntggattaggataagcctcctatgtttaggaaaaacaatttttaatatggtatattaagganacatttcctt

SEQ ID NO: 2959 - DNA, 400 bp; double-stranded, linear
cttctttctcaacatcaaagaacatatggttttgtttcaaatattcttttactagcgcgatatgttcgtctgatctaccagttaacttcatatatttaagagattcatcatcaactgggaagaatccgcaagttgctccatactctggtgccatgtttgcaattgtagcacggtctgctagtggtaaatgttgtacacctggaccaaagaactccacaaatttaccaacaacaccttttttacgtggctcttgagttactcttaacgctaaatcagttgctgttgcgccttgtggtaatgaatttactagtcgtacaccattaacctctggaattggggaaataggagggttgtccaggcattccagcttcagtttcaataccaccaacanccctcctag

SEQ ID NO: 2960 - DNA, 380 bp; double-stranded, linear
acgtcaaatgtaatcacaatcggaaagtatcgtgacaatgcatatataacagggagggtttaaatatgagttactaaggggatttttagatttaggtgcactgtttattttaccggttgtcatattcttgcttggcctattctttaggcagaaaattggagcggcatttaggtctggtttaacaataggtgtggcttttgtagggattttcttagtcatcgatttattagttaaaaatttagggccagcagcacaagcgatggttaaaaatttaggcgtcantctgaatgtggattgatgtaggttggccagcaacatcatctatcgcttgggcatcatctgtncgcnccattttattattccactcgggattcatagtt

SEQ ID NO: 2961 - DNA, 358 bp; double-stranded, linear
ggccattggtcgaacttacgaagaatcattgttaaaagcaattcgatcacttgagtatggtgtgcatcacttaggattaccaaatggtgaaagcntcgatcttgattatattaaagaacgtatttcacaccaagatgatggacgattatttttcatcggcgaacaattagaagaggcacaacagtagaagaaattcataatatgactcagattgattacttcttcttacacaagttccaaaacattattgatattgagcatcaattaaaagagcatcaaggtgatttagaatatcttaaatatgcnaaagattatggntttagtggtaaaacaatagcgcatcgccttaatatgacgg

SEQ ID NO: 2962 - DNA, 364 bp; double-stranded, linear
tttgggcatcattaggaaaattctttgagcaactttagtgtctactgggtaatacaattttatcaccatgtttttctaataaatcttttgcgaatcgattttatcttcttctaataatgaaataccaatttctttaccttgcgcttttaagaaagtataagccatacctccgccgatgataattttatcagctatgttaactaagtttttgatgacattaattttgtcagatacttttgngncacctaaaatagcaacaactggtttatgtggatcgttaactacgccgccaataaacttaatttctttatccattaagaatccagctgcagtttctaaatgtgtagaaataccaacattattn

SEQ ID NO: 2963 - DNA, 372 bp; double-stranded, linear
gttgatttcttgaaagataataaaaaattcaaagaaatgggatctaggattcctaaaggtgtcttacttgttggacctccaggtactgttagaaacattacttgctagagcggttgcaggtgaagctggcgcaccattcttctctattagtggttcagactttgtagagatgtttgttggtgttggtgcgagccgtgttcgtgacttattcgataatgctaagaaaaacgcgccttgtatcatctttatcgatgagattgatgctgttggtcgtcaacgtggtgcaggtgttggtggcggtcatgatgaacgtggaacaaaccctaaaccantattagttgaanggatggtttncggtggaaaatgaaggtg

SEQ ID NO: 2964 - DNA, 382 bp; double-stranded, linear
ttagcagaacgcccacaaaacctatctcttgctgtaaaagaatttgtgaanctgctggcttaaaacgtgttggcataattgcagctttaggagctacagttatgttaggtttaagtacaattaaaaaattatgccgtaaatagagcaagacataaacaataatttaggagtctggaacaataatcaatgttctaggctcctaaatgttatattggcagttctgaaacatttataaatctttgattatgaactcacaacagtgctctatgcttttatagattttaataaattagccatttcaattgcacttactgctgcttcacaccctttattgccagctttcgnacctgcnccttccacagctgggcaatactgccagccg

SEQ ID NO: 2965 - DNA, 400 bp; double-stranded, linear
gggaatcatacaatcattaccaataaacatgttacttatcacatgaaagtcggtgatgaaatcaaagcacatcctaatggtttttataataacggtggtggactttataaagttactaagattgtagattatcctggtaaagaagatattgcggtcgtacaagttgaagaaaaatcaacgcaaccaaaaggtagaaaattcaaagatttcactagcaaatttaatatagcatcagaagctaaagaaaatgaacctatatcagtcattggttatccaaatcctaatggaaataaactacaaatgtatgaatcaactggtaaagtactatcagtgaatggaaatatagtgacatctgatgcggttgtccaacctggcagctctggttcacctatattaaata

SEQ ID NO: 2966 - DNA, 400 bp; double-stranded, linear
tggggattcacaggctaatacatttgactttattagctggtggcggtaacggcgctgaactttaaatgcgattcaaagtgctgcaattataagtgcattcccattctcctttgtcgtcatactcatgatggtaagtttctacaaggatgcgaaccaggaacgtaaattcctaggtttaacattgactccgaataaacatcgcttacaagaatatatcaagagtcaacaagaagttatgaatctgacattcttgaaaagcgtcagtcacgtgaaatatagagaaaaaagataactaataaagtttagttaagtattttaataacaagtagtatgtcattctagtagctagaacggtnatactacttgtntgtttttgtggaaattgagtatttcaaaggtt

SEQ ID NO: 2967 - DNA, 387 bp; double-stranded, linear
acgaggaattagtgaagtacaatattatcggtggttttgatttaggtgttgtttcagacgactttaaaaatcacatgttaatagctgtaactgaattaagaacaaaagatgaaatcgatacatttgtagaaaaggctggtgagttaaatgactagtaaatcaagtccattaatttttgaaagatctcgtgaaggcagatatgcatattcattaccaaaaagtgatattaaaacaaattctgttgagtcattgttagatgataaatttattcgtaaaaacaaagcggagtttcctgnagttgctggaactagacttngtacgtcattaatcctggacctttccaaataaaaaattccggnggtagacaccgggtttaacccatggggt

SEQ ID NO: 2968 - DNA, 806 bp; double-stranded, linear
aacaagtgcaagtgagtcaacatcagaaagtgcgtcaacatcactcagtgactcaacaagtacaagtaactcaggatcagcaagtacgtcaacatcgctcagtaactcagcaagcgcaagtgaatccgatttgtcgtcaacatctttaagtgattcaacatctgcgtcaatgcaaagcagtgaatccgattcacaaagcacatcagcatcattaagtgattcgctaagtacatcaacttcaaaccgcatgtcgaccattgcaagtttatctacatcggtaagtacatcagagtctggctcaacatcagaaagtacaagtgaatccgattcaacatcaacatcattaagcgattcacaaagcacatcaagaagtacaagtgcatcaggatcagcaagtacatcaacatcaacaagtgactctcgtagtacatcagcttcaactagtacttcgatgcgtacaagtactagtgattcacaaagtatgtcgctttcgacaagtacatcaacaagtatgagtgattcaacgtcattatctgatagtgttagtgattcaacatcagactcaacaagtgcgagtacatctggttcgatgagtgtgtctatatcgttaagtgattcgacaagtacatcaacatcggctagtgaagtaatgagcgcaagcatatctgattcacaaagtatgtcagaatctgtaaatgattcagaaagtgtaagtgaatctaattctgaaagtgactctaaatcgatgagtggctcaacaagtgtcagtgattctggctcattgagcgtctcaacgtcattaagaa

SEQ ID NO: 2969 - DNA, 351 bp; double-stranded, linear
accatctactccgttaatagttacactgttatcattggtgtttggactttcagcccttgcatctaaaaatataagctgattaaaatctgttattacttcttccttgtaaccatctatgatttttacaaaagattgcattaattagtcaaacctcccatataattatttgcatttgctctatgcccactttgttttgacaatattttttctaaacctctaattgcatcattagaacctaaggattatcctgagaagaaacagtttgaatcaacgcatctgttaattnattncctttatcacttaacataacaatttggttcaacaatttncaactgtagaagtatcattatt

SEQ ID NO: 2970 - DNA, 359 bp; double-stranded, linear
agtgcttgatgaattttgaccacaaattcaaatgtatcaggcgtttcttttatccatttcaatatatttctttccggttgtatcgcatagtatgtcgcatctaattcgacaaccggaaaatgtccagcatatgttttaagtttatcggtttggcgttctaaatcttcatataatgaatagtgatcaccccaacctgttaatccgatgtttatcatatatatcaccaatgtcatcataccatataacttttatcataatcatttcagcgaactttagtttgatgtttttgcttgattaaaatcttttcggcgancctcagcttgatgtttttcgttgattaaatggtaaatagnnacgca

SEQ ID NO: 2971 - DNA, 400 bp; double-stranded, linear
cagacggtcaagaatcttatacttatcaaaatttatactgtgaagcgagtctattggctaaaagactcaaggcttatcaacaatctcgtgttgggctatacatagataattcgattcaatcgatcattttaatacatgcatgttggttggcaaatattgaaattgcgatgattaatacaaggttgacacctaatgagatgacgaatcagatgaagtcaatcgatgtacaattgattttttgtaccttgccactggaattacagggtttcaaattgtatcgctgggtgatattgaattcgctggagggatattacancgancagttgttgggcaacacaatgggtatccatttgaaccatcggatgnaactttgtgccgaaggtcgcctccacatntaatg

SEQ ID NO: 2972 - DNA, 392 bp; double-stranded, linear
tcaaccgctttacagccaaccggcgacgctgacatggatcgcctggcccatgcccacgccttggcgccatcattattaattgctgcagttacggtatctttaattgcgttaaataaaccttccattgaaaacactccttaaaatttaaatttgaagataacaaaaacgtgcgtantttttaaatcaccgaaatgttattcgcttaacgttttgttgttgttattttaaaataaatttgatgcaattagtttgtttatccgcacaacatcttataatgtacttaactgtattttaaagagaaaagaaatacagttaggcattcaaaactgtatttaacacaattaagttgcctgaattcgtatttaagtcttattgaacctttttnagataan

SEQ ID NO: 2973 - DNA, 400 bp; double-stranded, linear
attgcaatgatagcaatcggaatcgcacctgctaaaataaacgttgtgccatccgtcgcatttgtaccacgaatcacaatgtcaccaagcgtaggtgctcctataaatgatccaacggcaacaacacctatcgcaacaaccaaggcaatacgaatgccaccgataataaccgaaacagataacggtaattcaatcattcgtagcacttgattgcgtgtcattcccatacctttgccagcatccttaatattcgcatcaacactagctataccagtataagtgtttttataattggaagtaacgcatataaaaacactgttaaactactgttctganctagcctgactacattaaatagtnacattgcatgactggactgntggatatattgcatggatnc

SEQ ID NO: 2974 - DNA, 400 bp; double-stranded, linear
gtattctttaggtaatgcaacttttaatcctttaatatctttaccaatttcagatgtaaagtctacatcatcaactggtgcacttgtagagtcattaacatctgcaccagaaatagcttctaatacgattgcattatcttttacatttcgagtcaatggaccaatttggtctaatgaagatgcaaaagcaactaatccaaatcgagatacacgaccgtatgttggtttcataccgacaacgccacaatatggcagccggttgtctaattgaaccacctgtgtctggaacctaagctaaatggtactaagccagctgcaactgctgctgcagattccacctganggaaccacctgggcacggctttanggtcaanggggttaaacgtttttttggaaataa

SEQ ID NO: 2975 - DNA, 361 bp; double-stranded, linear
gagatcgcgggttcgattcccgtcgagaccgtacaaatgcctatccaagagatagttttgtnttgcgtttaatattatattaataaaagatatatggacgaatgataatcatattgatttatctgttcgtccattttctttaaaatgtatgaacctcaagtaacttagtggttggatatgaaagataaacgtngacaataaaatctttattagacgtacaaacatatgctactgtcaacatatttcttcgttgtgatatgccaccagtcctccataacatcaattgttaaagtaacgaataacgaataatgatatttnatttctgagccatgacgtgccactagaagttgcccattatcct

SEQ ID NO: 2976 - DNA, 356 bp; double-stranded, linear
tgctgcttctgaagcggagtaattgtgtatatcaaatgtcgctttttgatcaggaacatgatgtaaaggtgtatatgtttcacctgtttgctcatcatgtaacacggcatgcctatgactgaatgtaccacgttcactatcttgaccagttaagcgaatcggtgtaccatcttgtaaaattgtcgcaaatgcaagtngttctgcttgtgcccaatcaactaaaccatcttctttattaaacggctcatgacgcttctcaagaactttgtttaactttttncaaaatgttaaagccatccggatatgttaacaatgcatcattatttctttcaagtgatccaaaagtaaaggnttgt

SEQ ID NO: 2977 - DNA, 371 bp; double-stranded, linear
ctttagagcgacacctagtcactgcagcaagctatttctttatttgctatgctatanatcgttaattactagacctattgctggtagattgatggatgataaaaatgaaaatattattgtctacccagcatttatcatgcttttcctttcatttgtatgcttaatttcaagctatcaaagctggttaatattacttgctggtgcttgcctaggtttagggtatggaaatttatcatctgcaatgcaatctattgcgataaaagtctcacccccgattaaatatggtatcgcgacatctactttttacgttggtctagatgccaggtgtcggcttcggtccagcattccttgggttanttacgcagngtttt

SEQ ID NO: 2978 - DNA, 365 bp; double-stranded, linear
ttgtaatttcatgattacacctcaattgttcttgttgttaaaactcaatatttaattgtctgcgctcaataatttgttgtttaagttgctcaatatgatttgattggaattcttccaataatgcttttgctatttcaaatgctacgacatgttcgcagacgatacttgctgcaggaacagcacaactatcagaacgttcaattgttgctttaaagtcttctttagtattaatgtctactgaatttaatggnttatataacgttggaattggnttcattacaccattacgataattggcatccattgacataccgcctctaaccacctaagtgattagancacgataataccaattcactatatat

SEQ ID NO: 2979 - DNA, 400 bp; double-stranded, linear
tgattatataaatctaaccagccaagtttcgtctgcggtgagacattgacattaattgctgcagataatgatttaacaacatgtgtggcatgtgattcattaacgatgacaatatcatgtgttacaagatacccccaggctttaagactcggtagtactcgcgtaatgctttttcctttatggcgatgggtaacattgttaacattgcttcatttaaaacgatatcgaattgattgtcatcaaagggcaatttaacagcattcgcttgttgaacttgaatatatgattcangacctgctgcggaaatgttttccgtgctttttctaagccttcntattatatcaacgcctgangtgacaccanagtgtgagccagataaatagaggtgtgcacagataca

SEQ ID NO: 2980 - DNA, 384 bp; double-stranded, linear
tttctgcttttgataatctttcatcaatgcaaaagctacattggacagtcctataatggaaataatgtttacaattgccattaagcccataaataagtctgccgtattccatactgtttctgtttttacaactgcaccgacaaagacaagtactacaacaagacatctaaagataaataatattacacggtttgttgataaaaattcaatattagattgaccgtaatagtaattacctacaacagatgaaaatgcaaacagtgnaacgcttattggttaagaaaatacctccagcagaacctaaatgctccttaagtgccgattgggtaactgcaacaccntggagggcgtttatcaccaaatttncgtcccgaatatagtaaa

SEQ ID NO: 2981 - DNA, 380 bp; double-stranded, linear
aattctaacgatatcaccatttttacaaccacgttctctaagcgcatcatcaatacccatcgaacgcatttgacgagcaaatcgacgtactgctggatcactgttaaagtcagtcattttaaacattctttcaatagcattaccacttaccacataagcaccatcatcatctcttggaaattgtaaatttatcttgtgacggtgtatgtttatataatactcggttaatgccaactgactcctcttcttcaactgtggagtcaacatctttatattcttctgaatttatctgcttattgcatatgaataattgnncaatgattatcacgcgttattgttggaaactgggattaactggcacancttcggccaatttcttg

SEQ ID NO: 2982 - DNA, 389 bp; double-stranded, linear
cctcaaccgctttacagccaaccggcgagcgctgnacatggatcgcctggcccatgcccacgccttgggcncatcattattaattgctgcagttacggtatctttaattgcgttaaataaaccttccattgaaaacactccttaaaatttaaatttgaagataacaaaaacgtgcgtactttntgaaatcaccgaaatgttattcgcttaacgttttgttgttgttattttaaaataaatttgatgcaattagtttgtttatccgcacaacatcttataatgtacttaactgtattttaaagagaaaagaaatacagttaggcattccaaaactgtgattttaacacaattaagttggcctgaattccgtatttgaagtcctaatggaa

SEQ ID NO: 2983 - DNA, 379 bp; double-stranded, linear
atattcctatgacaatgttcaggcaacgattccaaggattaagaaaagatcaaccggtatacttatgtgatgccaatgggattgctagctatagagccgctcgtattttgaaaaagaatggatatacagatatctatatgttaaaaggcggctataaaaaatggactggaaaaataaagtctaaaaaatagtttttgtaaatttaatatacgatttaataaaatctgagtgttaattgatcatcaataacaatactcagattttaattttttaacaaagtctgttactatatttctctagcttcactgatcattaaaccttagtttcagcataattaaggaaggtccgncccatttccatcgngntccattaccgccac

SEQ ID NO: 2984 - DNA, 374 bp; double-stranded, linear
atgctgaaaatatggtgccgtttatatgaatcaatttgaatccgaacataatccggatacatattttcatacattgggacccgaattgacttcagcattacagcaaattgattattttgtggctggtattggctctggcggtacatttacaggtacgcacgttatttaaagcaacatcacgtgcaatgttatgccgttgagccagaagggtccgtgttaaatggagggccagctcatgcacatgacactgaagtatcggttctgagaaatggccgatatttttagagagacgcttgtagatgggntatttacgattaagatcnagatgcctttccgaatgtcaaagtttgctataatganggtgtagtaagcag

SEQ ID NO: 2985 - DNA, 464 bp; double-stranded, linear
ggagccaccattggagcangttacggtggaaaagatacggnaaggttngtatgactgtangtcttggatagagtaacaaacctaatttgttaactctaggccccatatgtcgcagtaccatctgcatgtgttgttacattgtatgcatttgttttacttggcttcttgtatgtcgggcgagctccgtatgacacttgaccgtttgcatgtgttgttacgttgtatgcatttgttttgcttggcttgttttgtgttgggcgagcgccatatgatacttggccgtttccatgtgttgttacgttatatgcgtttgttttgcttggcttgttttgtgtcggacgagctccgtatgatacttggccgtttgcatgtgttgttacattgtatgcattcgtttcgcttggcctcctgtatgtcggacgagctccgtatgatacttgaccattgcatgggtggtacgtnng

SEQ ID NO: 2986 - DNA, 359 bp; double-stranded, linear
taaaaatgaatcatcgccaagaatatctttttcataattaatgcctccaacgatataattaactattatattaacatacaatgtagggatgtgatgcgcgtgaagtttagggataaagataatcgtcaagttaatttgacatttaaaaaggataatgagatagcagatggcaatcatgtgctagctattccaacgtttaaaaatcaattgctttttaccaaacataatttacgggggattgaatttcctggtggtaaaagggaacgcggggnaaagtagtgctggaagcagttacacgtgaattatatgaagaaacaggcgccaaattgaaaaatgnttattacatagcacaatgtncc

SEQ ID NO: 2987 - DNA, 400 bp; double-stranded, linear
tagaattcttctaatgaatgagcttctttagaatgataaccataacgaattccgtcaaaacgagaaaggtttgacgaagcttctgatgatgcaatcacgtaatatgatggaataccaaatttagtatttggcaatgatacttcctcaacgacagcacctaaagattttaaagtttctacagcgttttgaactgcttcttttacgtcatcagctacaccttcacctaagtattctttaggtaatgcaacttttaatcctttaatatcttttaccaatttcagatgtaaagtctacatcatcaactggtgcacttgtagagtcattaacatctgcaccagaaatagcttcttaatacggttgcattatcttttacanttcgggtcatggncccattttggtc

SEQ ID NO: 2988 - DNA, 377 bp; double-stranded, linear
attcattcataattatcaatcctttgtgttaaattactatataaatagtgtacgnattttcgaaatttgtgatcataagtttattcaatgctaaacaataaggttgagacataatcgtatctcaaccttgaaattattatacgttgacgtcactagtcattcagttttcttaatgctgctacaatctcttttttagtatcttgtacttcagaagcttgcttaatcacttttgcaggtgtaccagcaacaactgcaccagctggtacatcttgtgtcacaatcgngccactggcaacaatagcacctttaccaacacgtacacctctaaaataactgcattgcaccgttaatacatcatccngattataaccgtggag

SEQ ID NO: 2989 - DNA, 356 bp; double-stranded, linear
ccaggnacctggacacgccgggtcttatcatcaataatagtagcatgacaaatctactattttttcgctaataagtggatgtaatgctaataatgttgctgtagggaaacagccaggattagaaatgagcttcgttccattgttatcaaacgattgccattctgaaatgctgtaaatagtcatgattcaaatcatcttgtgcctgcagcagtttctttgtaatatgcttcatatatttcacgnttcttaattctaaatgcgccagataaatcgataacatgaatacctttttctactaagggagggatacatgttttacttacgggtgctggtgtcgcaaagaaaattacatcaan

SEQ ID NO: 2990 - DNA, 349 bp; double-stranded, linear
tcattttccaagtgagactctgctcttgctttggctaatttagctctttcaacatcaatttctcttgcagtttctgcagtctgaacaatgattgaaactttatcttttctaacttcaacaaagccatcgcttacagcaatatattcagttccatcgtggaaatttcacttttacaaagcctgtttttaaagcagctacagttgggaatatgtccactcatgacacctatctcaccagctgttgtttgcataacaacgagttcaacattatcacgattgtaaacagaaccattaggagtgacaatatctaggtttaaatgtccattatccattccnccngaattggntga

SEQ ID NO: 2991 - DNA, 363 bp; double-stranded, linear
atggccacgttcatgccaatagctgtcgtagtcgcattttcacgttctagtattgcattttttaaatgcgatgtgtgctctacataacggcaaattttaagtttatgaatcaacatatcaattgcttcgtttcgagacatgtcgtggatcagtaattatcatagtttgttgatcaaaaacatgagaaggtttattgagatgtgaatgtttcgcggtgttatctacattgtcaacctctgtatcatgttgtgtaatatctgtatcatgaagttgcggttgcgctggtgcatctactgctataactggtgtattgcgttttaataatagtacagtagtncattgtngacaagactnaccgactta

SEQ ID NO: 2992 - DNA, 349 bp; double-stranded, linear
aagtttattttaaaattcgtaataaaaataataaactcatcgaacgatttaatggtctaggtttccatatcaactatgagtacattaaattcaaattcgaatcacgtaacgtaaaagatcaaacaatccctgaataaaacaccaagcaaataccctacagtacatcattagcatgtattgtgggtttttctactttttgtaaatattganaattatnagtagttgttttttactattagggcagaatgctttacaataacatgcaagtgtcaattaaggggagcacttgcataaatagtataggngagtgagtagtcctggccatttcctggaattccttaatcggcac

SEQ ID NO: 2993 - DNA, 399 bp; double-stranded, linear
tttgtgcaataagcgctttttgttcgtttgcttttgttgctaattcatctttcgcaacatctttaattgttgtatctgcagtaataccttgaatatcagcaactgcttgatctttaatttgcgtaacatcattagttgtttgtgcatttaagatatcttgatacgctttttctttagcttttaaaactaaatcttttgctgcatttttctcttcagttgtagcaccagttgtattatcaattgcttgattttgagttgtcacagcttgatcaacatcatttttagcattgatttaaccgctgtgctggttgcggcttgaattgaatcttccaggcttcgctgactacacatacacagtgagngnaatatttcggctgaacgcgtgcatgtgaangctct

SEQ ID NO: 2994 - DNA, 326 bp; double-stranded, linear
aatgacaggaatcgtcgttgcctttactaattgaccagttaattcaaagttaggtccggacattttgccatctttagcaatatcagtatatataatgccgccaagaggtatatccgataaccgtctcacaaactaaataaatttaactctgtgtcctcttcccatccgttcactttaatatcttctccataggcatcaacagataaataaatgcgacctggaaatgtatgtgccatctctttaagccaatcagtatcttgaatacctttcgttccaactatgcaataattaatccctgcggcaaagtagtccatgatttgtgactt

SEQ ID NO: 2995 - DNA, 400 bp; double-stranded, linear
ctaatgccgatgagcaaaacacaagcattagaaattattaaaaaagttaggtacgtatacaacattgattttgataaaccgaagttagaaatgtggattgatgtattaagtcaaaatggagattatcaaccaactgtaaaagcggtagatgtttatatcaacagtaacaacccgtacccgcctaacttaccagcaatcatgcgtaaggaacctaaaaaagtatctatcgagccagtagataacgaaaccgctacacaccatgggaaaatgcagaatgacccgaattgtcagacaaggaaaatagcgctagatagttcatgaatagttggcagattggggcgaacgatgatacgncattcgattgaagtcatatcgtcgtacttaacaccggacgttngaa

SEQ ID NO: 2996 - DNA, 400 bp; double-stranded, linear
gaatgtaagtgtcccttaagcatagtgctcccaccttaaattttgttacatactttcatggaatgtacgagaaattacatctaattgttgttcacgtgttaatttaatgaagttaacagcgtaaccagatacacggatgttaactgtgggatattcttctggatgttccattgcatctattaatgtttcacggttaaatacgttaatatttaagtggtgaccacattgcattgcgtaaccatctaacatactagttaagtacggtttgatctctggntctttacctaatgatttggnacgatactgatgtattgaaataccatccttacagcatcgtaaggggtcctagccacagaacttatgaagaaatgcaccttttnggcacnggcatgcatggggt

SEQ ID NO: 2997 - DNA, 335 bp; double-stranded, linear
atgatattaacctgtttacaagatggttgatacttgcgcatganatttgaatcttcaacaccatattattatggtacatacgaaactgaaaatgaatccatagttactgacaaagaaaaaatcttagtattaggctctggaccaattcgaatcggccaaggtgtagaatttgactatgcgacagttcacgccgtttgggcaattcaaaaagcagggtacgaggcgataattgtgaataacaatccaganacagtttcaacagattctcaatttctgacaaattatactttgaacctttaactgangaggatgtgatgaatatcattaattttgga

SEQ ID NO: 2998 - DNA, 397 bp; double-stranded, linear
gcataagtaccgccacctatagtataaggttcagtcatatcatttgtttgatttctatatgcagtaactaacttttgtacaaaaggatcatttttatcaacataatgtggtggttggactttacctaatttcacttcaaagtattgttgaatctcatttgcaaaacgatccatagctttttcaaattcaaatccttctgggtagcgtaattgataccgaaaagacctgcgttttcattatcatatgtaataacaccaatgttagttgtcacgtcacccatggacatctgtatgggaatttcattcccanctttttcaccaaaatcnggaattgaaataagtgagcgattacgaaatggcgacaaacgcctgtggcattgatngagcaagattnaagg

SEQ ID NO: 2999 - DNA, 400 bp; double-stranded, linear
aaagctgtgttggtaaagagttttgtcgatttggtacgcaatacacgacacgacttggcattcgtttagaaaaaacatttgaatacatcgatacacctcataaattcaaaatgggtgtatcaggctgcccaagaagttgtgttgaatcaggtgttaaagattttggtattatctcagttgaaaatgggattccaaatctatatcggtggtaatggtggtacagaagttgaaaaagctgaatttttaacaactgtagaaacagaagatgaagtaatcaaattatgtggtgctttgatgcaatattgancgcgaaacaggtatatatgcnggaaagaaccagcgcccaggttaagaagacctggatttgaaaatgtnaaaagaagtccttacctgggccccg

SEQ ID NO: 3000 - DNA, 506 bp; double-stranded, linear
aacggtagtattacagaaagctctacttatggtgataatgatacaccagcgccaccaactgacgaattaggtggtagttggacactatggaaaaatttagcgcgacaaagtcctgaatttggtaatcctgataagttttgccaaaatattcctaaaaaaagttggtttgtttcagcaacttctacaacaaacaataaagagattatcgatacaatagaaagtatttgtaaacgtgacccacttgcaggcaaaacagttacaggcggtattattacaatcaatgattctgcatggcaaatgagttttacaatcaatcgtcagcmacagtttaaagaccaacctgraaatgaaatatctacatggatttatgccttatatycagatgtaaacggcgattatattaaaaagccaattacagaatgtagtggtaatgaaatatgccaagnatggctgtatcncttnggtgtatcaactgacaagattgaagacttagcaaaacatgcgtc

SEQ ID NO: 3001 - DNA, 353 bp; double-stranded, linear
attgatggcatcgaaaaactttaataagacaacaagttgatgagatatatgtatataggtttggcatggatttcgattgcagttaattagaatagctcaatgctataaatgtaagtagttgatatgaagaaactaatgaactaaatgcaagtattgtctaaaacaatcattttattgaaatttagtagagctgaaattaatataacgtcgttaattgaataacgcttatgttataagagcactcataccanaccataatcatctatagntataacaattcacgtataaggggctgtgtttggcatagcccttaggtatacacctaattcccattaaaatagtaggggnttaaa

SEQ ID NO: 3002 - DNA, 400 bp; double-stranded, linear
caacaaaatgtctatatggtaagtggtaaaacgaaaaatgatgaagactattcatcaactattttatataacaacgaaaaagaattacaaaaaattactgatgctgctaaaaagcaaaacggtgtaaaattaacgattaaagaagaagaaaaacaaagtgtctttgtgagtatactttcaacattaattccagttgtagtcatagcgttattatttcttctcttcctaagccaagcacaaggtggcggtagtggcggtcgtatgatgaactttggtaaatctaaagcaaaaatgtacggtgatnaataaacgtcgtgttcgtttctctgatgtagccaggggccagatgnaggaaaaccaaggnttaattggaaattgttggtttcttggaaaggtaatg

SEQ ID NO: 3003 - DNA, 400 bp; double-stranded, linear
ataacatcggcacagcagctaaaataaccatacccaaaatgantgtatctttaaacgtgcaccgtaaagncttccgactagccatgtataagctttggcagcagataattgcttcgttgtaatgagtaatccttggacaagcgcaataaacaacgtttgcatcgaaataccgatgattatgagtgttgtcgggcgtatttgtcctttcgtttgaaacactaatagtatcatcattgcaactgcgccacctaatactgcaaatagtggagtaaatgtattgttaaaggctgaaaatgcaataaagacaacagcacttaagctagcaccacctgtgataccgctaatatcaggtgaggccaatggnntttttttatacattttggcaacatttaaccacttc

SEQ ID NO: 3004 - DNA, 354 bp; double-stranded, linear
ctaataacaaatgcgatgatgattaatactaatttacctgctgctaatacagaatctccaaggaatgagaagaatggttgacgttcaacttcattgtttttaagactgtagataatatcttctttctcttcaacacttactggattcaacaagcatgacacaataatcgcgttaacggatatttagtggaattgccgttagtaccagttctcctggtaccatttgtacatacgcacctacaatagctcccgatacagagctccattgacatcattgcgattgttaatacacgcatttcattncagacgttttagttgctcacttggatacgggctaangcttncgtgaattgcc

SEQ ID NO: 3005 - DNA, 378 bp; double-stranded, linear
ggtcagcttattgaacaagggacacgtgaatcagtcttgcatcatccagaacatgtttatacgagatttattatcaacgaagaagaagattaatgatcattttaaacatgtgatgaggggtgatgtacatgattaaaattaaagatgttgaaaagtcatatcaaagcgcacatgtttttaagcgtcgtcgaacacctatcgtgaaaggtgtgtcatttgagtgtccaatcggtgcgacgattgcgattatcggagaaagtggtacggntaaatcgacgtttgagtcctatgatattaggtattgaggaaccggataaaggttgtgtacccttaaatgatccaccgatgcntaagaggaagtgagccgccaccnattgg

SEQ ID NO: 3006 - DNA, 1785 bp; double-stranded, linear
acnttagttggccaagcctttatccggaattattgggccttaaagcccccttaggcggttttttaagtctgatgtgaaagccccggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgccantaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagcccttncttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaaggatatattcggaacatcttcttcagaagatgcggaataacgtgacatattgtattcagttttgaatgtttatttaacattcaaaaaaatgggcctatagctcagctggttagagcgcacgcctgataagcgtgaggtcggtggttcgagtccacttaggcccaccattatttgtacattgaaaactagataagtaagtaaaatatagattttaccaagcaaaaccgagtgaataaagagttttaaataagcttgaattcataagaaataatcgctagtgttcgaaagaacactcacaagattaataacgcgtttaaatctttttataaaagaaaacgtttagcagacaatgagttaaattattttaaagcagagtttacttatgtaaatgagcatttaaaataatgaaaacgaagccgtatgtgagcgtttgacttataagnatgnnngatatgttgaatatccatatctaaagctagatctaaactttgttcaaaatcttcaatcgtctgtttcggtaaatgatacattaaatctaaactgattgatttaatacctgcgtttttagcatttaacaccgaagtgtaaatatcttcagtattgtgcgttctacctaaaacagacaataactccggcttgaatgtttgaacgcccattgaaatcctttttactccatatttctctaatagttggactttctctttagttaactcatcaggatttgcttcaaatgtatactcgcctgtgattgtaaacgtatcacgtatt

SEQ ID NO: 3007 - DNA, 360 bp; double-stranded, linear
tgcaaaaaacacaataacgataaatgttcccattgatcctacagcatcgcgaacattttacctaagtcttttgtatttttaatttctttgcttaaaatcccataaactaatccaggtactaaaaatacgacaagaataattaatccgacaccgttaattaatggcgatcgtctagtaagctgcctgttttagcatttcttaaaaagctatgtcaggaatggctgtaataattaataaaataattgngctatgaactgatatttgccattttaaaanatgtgctctttgtcagaatatgtgagatgtnctcatggcatcatgcattaaactgcatcatattttcctaatctaggataatga

SEQ ID NO: 3008 - DNA, 350 bp; double-stranded, linear
ttgccttcaaacacatacttgtagtcggatgatcacctgttccaaaagncatacctgggtcgagctcaatgcaaagctcttcatccgcttctttagcatatgtttcccaactaggaactattgtgaacttcttcgacgctcgggaatggatggaaatagtttttccattcattttcccaatccgtctctgcaataatttgctcactgaattgaacgttatgttgatcaagttcatctaaatttaataactcatctttgaatttgctgtcgcaactgtatcatcataagtgcatttcagtaaaataggcttngcaancttactcccttatctgggataaagcctcggtttt

SEQ ID NO: 3009 - DNA, 383 bp; double-stranded, linear
tcttatatcaccaggaattaacactgccttttgaccactttcttcaatcacttggcgtacttcttgtgcatcttgttcttcactcggaagatagttaatcgctacatctgcaccttctttagcatacgcaattgctgctgcacgccctattgctgagtcaccacctgtgactaatattttatagccttgtaagcgttgatgaccttggtaagacgtttcgccacaatcgggtgctggcgtcatttcagattgtaaacccggtacctcttgttcttgtttttcataatccgttgttttaaattttgttcnaggatctkgagckgccattttttgacayctccgtatncgcttaatgggtatcatttaccccaatcttcctaagg

SEQ ID NO: 3010 - DNA, 388 bp; double-stranded, linear
taattcaacgggaattttccctttgaagttaacataacggtaggctgctttaacagcttcatcatcgggcgcttcgacatcttctaattcatatgcaatgcccaatgttttccacttatgaacacctaactgatgatatggcagaatttcaaacttttcgacgttatcaagagaattaataaattcccctagtttaattaaatcgtctttatcatcagaaataaccaggcacaagggacatgtcgaatccataccaggtggtttcatatctgacagtttgcgcgcgaagttaaaggatgtgtgtattagggctttcccggtccatccaaatanggttggtccattaatccataaggttttanaatcnaaataataatccagtccggta

SEQ ID NO: 3011 - DNA, 400 bp; double-stranded, linear
actgctgtaacgtcagttgatcttttcattcttggtttaatttctgagacgttacttggttgngcnangccaccaattgccataccgacagattggaagaacaatgcatcagttccaccaacaccaaagatgtcaccaagtacaacgaaacctacatatccaactgtagatacaattaaaatacccattgcttttttaaattcaggattatctgattgacgtncatttttagctttaagtgaagtaagtgctacaccagtaactaataatatcatggcgattaaaccaaagataatttgagtcattgaagaccattcacctaaaaagataacgctggaataatggtgtacccaactaattggcatacctggtaggaaactgggcataggtatttggatac

SEQ ID NO: 3012 - DNA, 400 bp; double-stranded, linear
ttatcggattcgttaatactggcggtttacgcaatagtttagatgtagatgataacaatgtgcctattaaatttaaagaagagttcgaacctagaaagtttgttttcactaacggcgaaattaaatacaatagcaatttcgaaaaagaagacgtaccgaatgcatcaaaccaacaaagtgcgtcagatttaagtgatgaggaacttcgcggaatggttgcgagtatgcaaatgcaggtggcacagtaaacgtattaacaatgggattagctcaaccaaacgctatgttaacaccacagttgactgactggaaactaccaaaccagtactgaggggncgttaataatgagtgtttccacttaagcataaacttttgttggtcttaaacggcattagtgtcg

SEQ ID NO: 3013 - DNA, 389 bp; double-stranded, linear
ggctgtaatgaaaatccaaaagccaagcttatttaattcgccttcatgtgtgcgtgaatcaatagtgtttgtatcatgactcatgacttacagcctccctttctttaatacgcgcttctcttaatctagcttcagtttctgcaacttcagcagcagggatatgatatccgtgatcgatttggaaactgcgataaatcatagtaccaaaaataccgaataaacaaattaatgctggaattacagtttcgaaaattaagaagaaaccgccgatagtcataaagataccaatccagaatccaacaggagtaatggtttggcatatggatggccttggnaataatgggttgncctaagtaatggccgaccaaggtcctttccanatccaccaa

SEQ ID NO: 3014 - DNA, 400 bp; double-stranded, linear
aatcgcttcggttaactgttctaaccattcgtaataaacatgtgtatgatcaagctgagctttaattttttgtgcctcttgtgtttcagcttcagttaaatcactgctttcaagtaatggattgataatagcttgagcatcttttactgcttcgacattgatgtcaatttcacgctggaattttttagtgaaaaagtttcggaaaaagatgaaaaagtctttctcggcgataaaatgtgtttgcggctcctctcgtaaattgtggttaacaatatcaaattcctgcaattcctaacgcagcactcatactngttgcncattgcaatgatgacgcattcacagggcaactgctcaacacatgggcataaagttccacactcataggcaacaatcatggcgg

SEQ ID NO: 3015 - DNA, 379 bp; double-stranded, linear
ncctatctctggtcgagagtctttgagctgaaaaatgtgacacacaaaattgcaatggnatcaacaaatgtttcccattgtggatggtcttgactaagtatttggtgttcaacttggtgatttgccatgactaataccatgtcatttgtacttgtatcgccatcaacagtaatcatattaaatgtatggtcagtcgaagattttaataattgatgaagtgtattcgattcaatcgatgcatcggttgttataaaagcaagcatggtagccatatttgggtgaatcatacctgaacctttggtgctaccaccaattgtaacggtttaccatcgattttagtgatacagcgatatgttttgtacaggtatcagtgttaaaa

SEQ ID NO: 3016 - DNA, 400 bp; double-stranded, linear
catataaattgctaacgtgccaccattcactaaggaattgacatccacttcattttcttctgaatctttaaagtgacctgtagaaaatgtcacacttttagcaactgtacgcattgtcaaacctgtctgcatagtagcaactgctgcgctcgctgatgtcacccctggtacaatttcaaacgcaatatgatgttcatttagtatgtcgacttcttcttgcacacgaccaaatatcgctggatcgccaactttaagtctaacaaccttgttatatcgacgcgtgcttccacgatacagtcattatttttctggcggaaaatgtttggaaacggcttttaccaacanggtaattcagaggcaatcgcaatgnaaattacggntcacnaacggtcattggatg

SEQ ID NO: 3017 - DNA, 310 bp; double-stranded, linear
cctttttctcttctttcatatctgcaaacgtgcatcaattttaggatctaaatctccaaatgcttctgcaactggttcagagcgttcataatacatacgaacttttggatataacgctttgcttgggccatatcattattttcaatcgctttaacaaatttttctgtaccttttaaaaattcatttaactgttcatcagtatatttatcatatgcttttgttgcttgttttaattctgctttaacaccatcatcttttttcgatgtctttgaatcatccttcttactatcgtcgttccccacatgcagca

SEQ ID NO: 3018 - DNA, 350 bp; double-stranded, linear
tcgctttgtaaattctggaacaaagncagtcatgacaacaattcgtgttgcacgtgcatatactaaaagaaataaaattataaaatttgctggatcttatcatggccattctgatttagtattggttgcagcaggtagcggcccatctcagctcggttctccagactcagctggtgttccagaaagcgtcgcacgtggaagtcattactgtacctttcaatgatattaacgcctataaagaagcaattggaattttggggtgatgaaattgccgcagtattagtagaaccaattgttggtgaactttgggaatggnnaatgcctcaacctgggatttttaggaagagggt

SEQ ID NO: 3019 - DNA, 400 bp; double-stranded, linear
atatcatgtgccagtgaaagcggcactggncggatatggcgcacatatggacattatgaaagagtaccaattaatcattttagcgccacaagttgcgtctaactatgaagatattaagcaagatacagatagattaggtattaaattagcgargactcaaggtgctgaatatatcaaattgacacgrgatggccaagcagcccttgatttcgttcaacaacaatttgaaaattaagaataggagtttttcatatgactaaaacattacctgaaggattttatttttggtggagcaacagcagcatatcaagcaggaaggtgcgaccaaattacgggatgggttaaaggtcgcgtgcattggggatacggtattttaggaaggaaaacttatttggtacca

SEQ ID NO: 3020 - DNA, 361 bp; double-stranded, linear
acgttcgtcttacgtttaacgccatacggtgtattagcaattatggnccaacacattatcgacaagtgactttggcgccatttggactttaggaaaaattcttaatcgcatcgtacgctgcattaattacgatgtatatcattcacttaattattttaagcctgttaggtattagcccaattcgctatgttaaaaagactttggaagtattaatctttgcattcacatcacgctcaagcgcgggtgccttaccaatgaatgtaccaacaccaaccagacgtctaggcgtgccagaaggtaatgncaatttcgctgcgacatttggaatggcgattggaccaaatgggtgggcaagnaatta

SEQ ID NO: 3021 - DNA, 356 bp; double-stranded, linear
caatgaccatgaccagttgatttggaacaatgattgacattggagctatgcatcaagtttgtctttaagactactaaacccacgaaccatgttaaccccgtggtgcaccatcaccaattgnctcgatctaattcagttaattcagattcatgttttttaaacgtttcttctaaatttaataaacgtgnctttcatatcattcactttcatttgtgnccacctcataaatgtatattatcatattcactcttattaaagtatgactgttgttggtgctaaaaatgctccaaatattcggtttattaggcacgatagttatagaaaaacctgacagtctaaagatgtcatataatcac

SEQ ID NO: 3022 - DNA, 332 bp; double-stranded, linear
gggtccattccatgacaacantgtgtgtcaccttctaattcatctgcaaataattttacagtgtttggtccaatatccataccttcttggntctgctggaattgaatcagatggtactacagtgattttggcatcattagnaaaattctttagtcaactttagtgtctactggtaatacaattttatcaccatgtttttctaataaatcttttgcgagtcggattttatcttcttctaataatgaaataccaatttctttaccttgcgcttttaagaaagtataagccatacctccgccgatgataattttatcagctatgttaactaataa

SEQ ID NO: 3023 - DNA, 311 bp; double-stranded, linear
aaaggtattccacaagaattagctttgcaaaaatgccaaagcaaacagaagatggnacaatttaaagtgncctacaatcatgaatgaggaggacgcgtaagatgagcattcgctacgaatcggttgagaatttattaactttaataaaagacaaaaaaatcaaaccatctgatgttgttaaagatatatatgatgcaattgaagagactgatccaacaattaagtctttctagcgctggataaaganaatgcaatcaaaaaagcgcaagaattggatgaattacaggcaaaagatcaaatggatggccaat

SEQ ID NO: 3024 - DNA, 319 bp; double-stranded, linear
attagacattacaaggtgcagtacgtgcaacatattagacatattgaattaagtggtcatgnaaggtattgacagttaaaaaagttgaacaattagaagaaatcgagggcttaatattacctggtggcgagtctacaacgttacgtcgattaatgaatttatatggatttaaagaggctttacaaaattcaactttacctatgtttggtacatgcgcngattaatagttctagcgcaagatatagttggtgaagaaggataccttaacaagttgaatattactgtacaacgaaactcattcggtagacaagttgacagc

SEQ ID NO: 3025 - DNA, 320 bp; double-stranded, linear
ggtgccaagcaataaatatgactatgctcaaactgaattaatggtgggtgtgtcgccatcgtaattggatcgtctgaaggcgcatataaatgatagtgctcttcgaataaaggtagcatatgtaattgtttgtgtttacgtatttctggtggtaagttccgtgaaacccaatgtctatattcccatttaatacgctatttataantgtgtcatgttctaataagctcggtatgacatgtgtatcattttgtaaaatgaacgtttggataagngggagtaacatgtgggatacgtcactctcatcaagccatgtagatacn

SEQ ID NO: 3026 - DNA, 328 bp; double-stranded, linear
tctcaacaaatgcatccagtacttaaattggcattatagtaatttaagnacaatatatcaatatttctccttatccagcaacagcaaatttattggtaaggtgtacgattgaacctttagtcaatgaagcaggtacatttggattggccaggtggatttacttcaactgagcgctttgtgagaatgggcatttatgaaagcaaacattgctcaaaacaatgataaagaaatggatttaatgaatgcattttatttattagatgcggtaaatataccgattggaattgtacgtccgcatgatgctgacaatcactatacgatgtatcca

SEQ ID NO: 3027 - DNA, 322 bp; double-stranded, linear
tcgtaaaatatcatgcaacattcagatcacctctntcaaatccaacggttaatacttttaattgaaaatatgtgttctntgtaaaattttaatcgttcgccacgatgctgttgataaaaattcaaaaactggagttgatcttctagttcaacataatcatcgtaattagacatgtaacctttgattaagatttcaagtacatgatcttcgatagtattgnttttaacttgttgttgagccgctatatcttccatcgtggaattgttcaagcaattttgtataagtaatataagttcgatttaatgaatgtaggtttcattat

SEQ ID NO: 3028 - DNA, 313 bp; double-stranded, linear
caagaatcttatacttatcaaaatttatactgtgaagcgagtctattggctaaaagactcaaggcttatcaacaatctcgtgttgggctatacatagataattcgattcaatcgatcattttaatacatgcatgttggttggcaaatattgaaattgcgatgattaatacaaggntgacacctaatgagatgacgaatcagatgaagtcaatcgatgtacaattgattttctgtaccttgccactggaattacgagggtttcaaattgtatcgctggatgatattgaattcgcccnccgggcntattacaacg

SEQ ID NO: 3029 - DNA, 386 bp; double-stranded, linear
cttccaaagaaaagaccacagtttttgacgcatcaatatggtgcaattttagagacactgtagttgcagaagatggttcagttggactttgaagacaatcgttatacagaaacacgcgtgccgcttatccaattaatcacattgacaatattgtagtaccatctaaagcagcacatccaaatacaattattttcttaactgcggatgcatttggtgttattccaccgatttcaaagttaaataagaccagcaatgtatcatttcttgagtggttcacttctaaatagctggncagagcgtggtgtgacagacctgaccatcatctcaacatgttcgngcaccgtcttccgtacatcnactgttacggtgtctataggtgactatcg

SEQ ID NO: 3030 - DNA, 400 bp; double-stranded, linear
tgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgangaaggtcttgtagtagactttganatcgaggcgacttccctaaatacggtaacaatgacgaccgtgtagatgatattgcagttgatttagtagacgcttcatgactaattacgtggtcattaaacatatcgtgattcagaccttccatgggngtattaccattacttcaacgtggtntcgggtagaaactgggt

SEQ ID NO: 3031 - DNA, 319 bp; double-stranded, linear
ngcgtttaatcacatctttttgataatgttcccttaccatttcttcatgtgcatctgcatagtcttttccaaatggcaaactaaactgatatgcaacttttaaataggcatctatatgcgactcgtcaacgatggcaatttcaacgtcnagttacgcggacaaattggcaagcgcatcactttctatggcatacaattccataatacctagttcaaaattcatatctttaaaacatagccatccaatggattatcaagttgttcattttccgggaaaactnaaacgcataaatgatttggaaccttgatttgtatgtga

SEQ ID NO: 3032 - DNA, 400 bp; double-stranded, linear
aagaagtggcaattatgattgatgctctagctgacaaagggaaaaaagcattagaagcattatctaaaaagtcacaagaagaaattgatcatattgttcatcaaatgagcttagcagctgttgatcaacatatggtgctagcaaaattagcacatgaagaaactggaagaggtatatacgaagataaagcgattaaaaatttatacgcttctgaatatatatggaattcaataaaagacaataagacagtagggattattggtgaagataaagaaaaaggattaacgtatgtagcggaaccaattggtgttatttgtggtgttaccgcccaaccaccaaatccctacgtccgaccacctatttttaaagccgatggatttgccatttaagacngggaatc

SEQ ID NO: 3033 - DNA, 303 bp; double-stranded, linear
tagcggtaatcgaaattggggactaaatttcgcaaaagcgggtcgcacgatatcagaagagtataatgtccctttattaatgaagtttgagttacatggaaaaaacaaagacgttattgaatttaagaacaaggtgggtaattttaatgaaaaccatggaagagaaaaagtacaatcatattgaattaaataatgaggtcactaaacgagagaagatggattctttagtttagaaaangaccngagctttagtagcttatttagaggagtaaangacaaaacatcttcttcgacactgaatcg

SEQ ID NO: 3034 - DNA, 340 bp; double-stranded, linear
ctncgctattttgtaggacatcttctaaagtgctaggngaagagattatagaataggcactatcaataccgaaatcgtaaacatgttgataattttcgcctagactgccacaaatcgcgatgacaggaatatgatattgttttgcagctaacgcaacgcctgacgggtgttttaccaaagatggtctgataatccatgcgtccttctccagtaataacgaggtctgcatctttaattctttgatgaaaatctgtaatgtcaaagacggacatcaatgacttttgttgaaagttgtctcacaaaacgntaatgaatgctgcggcccatgaccggccagctg

SEQ ID NO: 3035 - DNA, 303 bp; double-stranded, linear
aaagaacatggtgtagcaatagtctctggaggtggaagcggacatgaacctgcgcatgccggttttgttgcagaaggtatgctagatgcagcggtttgtggcgagtatttacatcacctacacctgataaaatattagaagctattaaagcagtagatactggtgatggtgtattactagttgtaaaaaactatgcaggtgacgtgatgaatttcgaaatggcacaagagcttccagaaatggaaggtataaatgttcaaactgttattgttcgtgncgncattgctgtgacaaacgngtaca

SEQ ID NO: 3036 - DNA, 315 bp; double-stranded, linear
ggggaaagtaaattaacagctgtgtagaataattaaggttttaatttatatagaacaacttattgtaaacttttcatttcttaaagtttacaatggtgctataataatggtcatgaaatacgaaaggaaggaaaaaatgacnacaaaacagttagtatatacagctttaatgacagcgattatcgctagtttangattggtaccggtaattccactaccattgncttcagtaccaattgtacttcaaaacagtggtatttcttagcaggggcgattttaggacgtaaatatggcacattaagtgttatcgtcttt

SEQ ID NO: 3037 - DNA, 330 bp; double-stranded, linear
gcaccaattgacgaaggaataccgaatcccattgttcctaaaccaccgcttgtaacccattgtccgtgatttttaaatggataaaattgagctgcccacatttgatgttgtcccacgtctgtagtaacaattgcttcaccatttgtaattttgccgatatattcgattgtttgttgtggcttacaaaatacttgatcttcttcaccaagtttaaatgggtgtttctgcttattattttgacaatgtttaacccagtcactgtgttctatagtctcaacatttttatcatttaaaccntccaaaaaacctttacangccngcaaaaaaacc

SEQ ID NO: 3038 - DNA, 334 bp; double-stranded, linear
gtgagtccacataataactttgacgtcctgttaatgttctaaaaggtactagacgttctatattcgttgtaaatggtgaatatcgtcgaccttgtttatttgaacctgggaatactgctgtcggtattacttctcgtggttgtgaagttatatttaaaaacgaaattttctcagcagcgctgtcgctagaaatatcttttaacggcattccagtttgttcttcgagatcttcatatggatttttgtgnataattnaccattcgtagcagatggaaatacttgagtatnggcatcagcgacattgacgtgctgtatcaatacgtggacgattcgc

SEQ ID NO: 3039 - DNA, 327 bp; double-stranded, linear
ggtctgatcgtggtgaatgaaaaaggttcttctctgtaatgaattatctcttaccgatgcaagatattatgagcatgcattgctcagcaaacgttggtgaaaaaggcgatgttgcattattctttggtctatctggcactggtaaaacaacctttatcggctgacccacaccgtaaactaatcggtgatgatgaacacggctggaataaaaacggggtctttaatatcgaagtggctgctatgcaaaagcaattaatctttccaaagaaaaaganccacagntttttggacgcattcaaatatggtgcanttttagagaacactgta

SEQ ID NO: 3040 - DNA, 305 bp; double-stranded, linear
gtgatattcacgancgttattttcaatatttgataagtagaaantatgacgatcttcatgaacagcatcttgttcttcgtcaaattcaacgtcatcaaaacgtttgaagaatgtttcatatgcatcaacagatacttcagtacggttatttaataatgctttatgtgcagcttggatctaaatgatctttgtagccttcaactnaatgtcgcactataaaattcaccaactgaacctgagccataactgaataaaccgattgtttccaccagcttgtgaatctcgattttcaagtgaatgatatt

SEQ ID NO: 3041 - DNA, 317 bp; double-stranded, linear
gttgtgtaccttaaatgatcaaccgatgcataagaagaaagtgagacgtcatcaaattggtgctgtatttcaagattatacgtcatcattacatccatttcagactgttagagaaatcttatttgaagtgatgtgtcaatgtgatggacaacctaaagaagttatgggaagtccaagcaattacattgttggaagaagtcggtctatctaaggcatacatggataaatatcctaatatgttatcaggtggagaggcgcaacgtgntgcatntgcgcgtgcaatatgtattgaacccngaaatatattttgtttggat

SEQ ID NO: 3042 - DNA, 351 bp; double-stranded, linear
aatcttcgaaaaataatgcaatgcagattccgaaaaaaacaatatgatagaaacacctcaattaaatacaacggctaatgatacatctgatattagtgcaaacacaaacagtgcgaatgtagatagcacaacaaaaccaatgtctacacaaacgagcaataccactacaacagagccagcttcaacaaatgaaacacctcaaccgacggcnattaaaaatcaagcaactgctgcaaaaatgcaagttcaaactgttcctcaagaagcnattctcaagtaggttattaaaacacggatggtgctaatagcttngcaacaacgtgggctttaaaattctccaactttagtttt

SEQ ID NO: 3043 - DNA, 319 bp; double-stranded, linear
acgnccttactggntacttggttgataagtgttaatccaaatgacgtcctgctacgtacagctttacgaatatttaatgcacgtgtgatattttgagaaaatacaccgcctggctaaaccatactcagaatcattagctatatcaattgcttcttgatcgtccttcactttaatcactgttaacactggtccaaatatttcttcttgtgctaatttgtgatgattgtctggcacncaattaatgtcggctcaaagaagaaccctttatctaatccattttcagttaagcgatgaccgcctgctaaaatttgtgcatccg

SEQ ID NO: 3044 - DNA, 342 bp; double-stranded, linear
gtcatataatctaacatttgtgttatctgttaattaactggnttttaccttaatttgttacattgntctgtattaaatctttttgtaaccattggttactttttcaggtggaatttcaacacccatgtcaccacgtgncaaccattaaaccatcagacacttcaagaatttccgcaatattatcaataccttctggttttcaattttaggaatactgaaatgttagcttttgttcttctaaaattcacgaatttctaaaacatcactaggtacgacgtacgaaacttgctgcaatgaagtcaacattttctttaataccgaaacggatatcttcagcatctt

SEQ ID NO: 3045 - DNA, 400 bp; double-stranded, linear
taatatcatgttgtgcttttagtgcttcggcaatttgttttgtacttactgacccaaacaatttaccaccttcaccagtttttgctgatacttcaacttcaatgtttgataacgtttcttttaatgctttacatcttcaatttcttgttggcgttcttgttttgcacgttttttctgtaactctaattgtttaaggttacctggtgttgcttctacagcataattctttttcaataagaagttatttggcataacctactggtacttctttaacttcaccttttttacctttacctttacctttaacanctgtgtaaaaattactttcatgcagntcactcctacttaaatgttccgtaatgcctgttgtaatgtgccaacgccnctcgacgtgacacct

SEQ ID NO: 3046 - DNA, 306 bp; double-stranded, linear
aatcactgtttcattacttgttccaaatctgnattcaaactattgttcaaagattctaattccgctttatttttatctttaatcgcttttgtcatcgcagcatctttagncatcgacttnctgttgcaatagtttaattttagaacccgcatctttactagccaatttctcttcataagcaattaatgacttcgttaattgcgaaagtgtatctttttgattatcattcgcttttgcatcttcaagctttctcacatctgcatttgacagcattacttgcactattatcttcaagcgataatttct

SEQ ID NO: 3047 - DNA, 306 bp; double-stranded, linear
atggatcatattagcacgtaaaagaaaattctgttcattatgaagaagtgccagangttgaatttaaacgcacatatgtatgtgaagatatgtctaaatgtatttgtttatacaacgcacctgatgaagaagcggtantcgcgcgcgcaaagcagttgatacaccgattgatggcatcgaaaaactttaataagacaacaagttgatgagatatatgtatataggtttggcatggatttcgattgcanttattagaatagctcaatgctataaatgtaagtagttgatattgaggaactaatgaac

SEQ ID NO: 3048 - DNA, 287 bp; double-stranded, linear
gacaggctacgagatattttaaacaaatttacatcaaatccagtattaggtgttattgcaggtatcgttgtaactattttaatacaaagtagttcaggtacgacattatcacaatcggactggtaacnctggatttatgacattgaaacaagccattggagtgataatgggtgctaatatcggaacancggtaactgcatttattatcggtatagatttaggcgaatatgcaatgccaattttagcattaggtgcattcttgaatctttttctttaaacgctctaaa

SEQ ID NO: 3049 - DNA, 371 bp; double-stranded, linear
catataaatagcgntacatcgcgccattcttgatctgnacatatctttcttaggtccaaccgtgaatgattacgtccatgataacgtacaaacgcaatttcatttgtgattcgattgactaaaggtacactgccatctttcacttgtggttcatcaactactgcatgaatgatttgatgttctgttaaaaatgccaatgtttgttctttaaatgcatcactaaaccatgattgatgcctaaattctacacacattggaaagcttgtaatgctgtcttacatacaaatatattgatatttgtgcatgcagtcaaccaggcggaaatgaccataccatgctaattttctggtangaaggcctacatatctaaa

SEQ ID NO: 3050 - DNA, 323 bp; double-stranded, linear
cgccaaataaagataatacacgtattggtgaagatataactgtaactgcacatatcttaattgatggcgaaacaacgccgattacgaaaacagcaacatataaagtagtaagaactgtaccgaaacatgtctttgaaacagccagaggtgttttatacccaggtgtttcagatatgtatgatgcgaaacantatgttaggccagtaaataattcttgtcgacanatgcgcaacattgaatttccaatttgttggancatatgggctaacaaggtgtttaggcatatctactcgtcttattgggtgcatatgtaatggcaagca

SEQ ID NO: 3051 - DNA, 325 bp; double-stranded, linear
ccgnaccaatcggtttacagttcattggtaaaccattcgcatgaaaaaacgttatatcgtgtcgcttatcaatatgaaacacaatacaatttacatgacgtttatgaaaaattataaggagtggaaatcatgcattttgaaacagttatagacttgngttcacgtagagttaaaaacggactcaaaaatgtttctccatcaccagcgcatttngagcagaacctaactcaaatacgaatggtatcgcttagcatatccagtgcttaccagttgttaataagcgtgcgtagacgggcatgcgtgctgcaatgcctaaataggaacg

SEQ ID NO: 3052 - DNA, 400 bp; double-stranded, linear
cttttaatcgcttgaaaactataggtaagacaatacaagtagctacaaagccatatattactgttaattgacctatgaaaaaatatccgctaacgggtgccgtcaatcctgcgatagcaataccaataaaaagtacagtccacgaaggataaacattttcaagtgaaaaatcttttaaatattttattgaaaaaataatcatatgcgtcataattcccacaaggcataaaatccaaataggcgtattaagctattgtaaagtttgttactaaaaaatgttttaaatagtgtnctaaaaagccggcatgaaaatgtgtgacctgatgaactgaggctgttattgtcttcacttattaaatttgtctagtctaaaggtgatccaatcagaagcaagtccgca

SEQ ID NO: 3053 - DNA, 367 bp; double-stranded, linear
aatgagatgcgaaggatgatcagagaaaaagtctctcaatcaggtgtgaaagtcagatggttatcacaactttggcgtacgttttcgatataatgcactaggtgatttaaatacgagcaatattgtttcttcaaaagaaagtttcggtattactgaagtgtgaaatctgtctctatgcatgccggatcgacattagcattactaatccagagaaagcaaaaggtattgtgtatacaccagaacattgccagcgaaaagtaaatggtcacagctgtagancaaggtatttataatgggggcggtaaagcagaaggcccctatgtagcatttcntaaagntgggaaaaggtaaagcagcattatcggtg

SEQ ID NO: 3054 - DNA, 382 bp; double-stranded, linear
cattttcacaagatcaaacaagtgttagaagtggcatgtgaatgatgtggcacaacatgctnatttatctnagctcatgacatgatggctgttcacattgcaaggcgttgatgatnaaataaggaaaggcattaggaaaaagccacagggaaaacatttcagcagcaggttcttggaatcatatattcaagttcaacaagcgaatgctgttaaattgccctttggatgacaatcaattcgatatcgttttaaatgaagcaatgttaacaatgttacccatcgccataaaggaaaaagcattacgcgagtactaccgagtctaaagcctgggggtatctgttaacacatgatattgtcatcgttaatgaatcacatgccacac

SEQ ID NO: 3055 - DNA, 316 bp; double-stranded, linear
cttaagattaggtgtgcttaattagtactggctgggaacgataaaggcatattgcaaaaaatagaacatccatatccattaaatgtatttacgctaaatattgncgacttatatttttagacatagagaagagacaagacaatttttaacgatgcaacgacagttaggctgaggcagttaaaacaaatatttgatacacatgttgncagataaaagtcagtgttcccatcaaatgcnaattttgtactactaaaagctcagcagcgcaacaattaggacaatacgtatatgaacaagggatttaaacctcgctttt

SEQ ID NO: 3056 - DNA, 380 bp; double-stranded, linear
gttcaccatccgtttatttcaatgaaaaaatcgacaaaaatggtcgtgaaaactatgatgcaacaattattccaaaccgtggtgcatggttagaatatgaaacagatgctaaagatgttgtatacgtacgtattgatagaacacgtaaactaccattaacagtattgttacgtgcattagggttctcaagcgaccaagaaattgttgacctttaagtgacaatgaatattacgtatacttagagaaagacngcactgaaaacactgaccagcgtattagaatcatgacgttacgtccagtgaccaccacctgttgaaatgctaaaagcnatgtatcacgttcttgatccaaaacgcatgacttagcagcgtgggncgtat

SEQ ID NO: 3057 - DNA, 327 bp; double-stranded, linear
tatgtgatggacttaaaaaaacgaactcaattaatacaatgggctcaagaaaaagaagaacgatttattatagaagatgattatgattccgagtttagatatttcggcaaacccattccagcaattcaaggtctatattcaagaggagaaaaagtgatttatatcagtacattttgcaaagtctatttttcctagctgttcgagttggcatatatggtgttaccctattctatnatggaaaaaatatcatttctncaaaatccaccattggaagggcaacactggtaacctgtttcatatggcaaaaccttattggcaacgtttnat

SEQ ID NO: 3058 - DNA, 284 bp; double-stranded, linear
cgaaaaaggagaatgaaacatgaggtaatacaacattacatgcaacaacaatttatgcgtgtaagacataatggaaagcagctatggctggagatgggcaagtaacgcttggttcaacaagtcatcatgaaacaaacggcaagaaaagtgcgacgtttatatgaagtaaatgttagctggtttcgcagtatgtagcagatgcgtttacttatttgaaaaattcgaaacaanattacaacagtttagtggtaacttagaaagagcngctgttgaattggcacaag

SEQ ID NO: 3059 - DNA, 302 bp; double-stranded, linear
aaagaagcggatgaagagctttgcattgagctcgacccaggtatggcttttggaacaggtgatcatccgactacaagtatgtgtttgaaggcaatagaaacatatgtattgccacagcattcagtaattgatgttggtactggctcaggtatattaagtattgcaagtcatctaatcggtgtaaaacgtattaaagcgttggatattgatgnaatggcagtgagtgtagctagaaganaacttcagaaganatcattgtgaacgttgaattggaagctgttccaggttaacatattggaaag

SEQ ID NO: 3060 - DNA, 330 bp; double-stranded, linear
tttttaangacacattgngctgtgtttaatgcatgaaaggaaccactgacatgcatnaaatctttgaatggttctttatcaattccttcccccctctcatgttttgtatctttaaatcaatataattcaaaaagggtcgaggatatgaaatcacatcttcgaccctttatttactattttaattcagccacacgcaaacggttatttgctctctctaaagctctttcggctctatggaatatcagtattgtcgtcaatcattttccaagtgagactctgctcttgctttggctaatttagctctttcaacatcaatttctcttgcagttc

SEQ ID NO: 3061 - DNA, 301 bp; double-stranded, linear
cgatcaatcaatataattcacggcgcaaaacgtttatttagcatgttcttgcagactctgaaactggcattaaaccttccattaagatttttaccattctaggcattaataccattactgcagccattgacattcctaaattaatgatgtctccaggtttgtaacctgctaacacaccaatacctaamcctaaaattaagccgacaaatatagactctccaaatgcgccaaaacgtttttgaattgnttcaggatcagcatctaactnattcagaccgggtactttttgtaacaatttaac

SEQ ID NO: 3062 - DNA, 350 bp; double-stranded, linear
tataaaatcaatgattttaacaaataaaaacgtaccgcaaatactgcaaataacagcaaatactagttttaataaaatatgaccggttggaaagaacaataaagcaattaaaatacctagtttagcccattccatcgttccagctgtagtcggactaacaaacttattttgcatcatttgttggcattatcaagcctgctgaaagccaacgaacttccagcaattaaaatactcatcgtccttggtattcgggcttggagaataaaatgattccgctggtgactcagttgaaatgtagtgaaatctttgaattggatagttncactgcacacctgatggnancaacggaa

SEQ ID NO: 3063 - DNA, 342 bp; double-stranded, linear
ttagtgattttaacgtgtatcggtaattttaaataaatgtttaatgcttttgaaaatacagttctaaccgaagacgtcgggtacactgaatcaccggaaacgccaaggtcttttattaaaccttgttcactatattgcatatactgtggatgctgtcgcaacacattgatttgataaggatgtgttggtaataaaataaaatctttgggtatctctgatatatctatgtctgctaattggatacnacactttctcaacctggatccttccttttacctnccaccatagccgcgtggancaggaaaccatcctgggatgcaccagccaaaataaatgccaatt

SEQ ID NO: 3064 - DNA, 316 bp; double-stranded, linear
gtccagctccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcntgttgtgtatcagcgatgacaattggtaaacaaatgcaattcttcggtgcacgtgcgaacttagcnaaaaccttactttacgctatccatggtggtaagattgaaaatctggtgcacaagtgggcccaacctccgagggattnaccagcggagtaatt

SEQ ID NO: 3065 - DNA, 322 bp; double-stranded, linear
tgattgcgtggatcagcaacttcaaagattaacaaataatattacttgggcagataaccgcgctgcaaaatatgcaacagtaataaatgaagtgcatgatgggcaatgcgatttaccagcgnacaagcacancggtttcatcctatgtcgccattagcgaagatttttggatgaaacatgatggccagatgtatttccacgtactgctaagtttgcagatattaaaacatacatttctatcattattgatacatatatcattgattattccatggcttccgcnacagggatgttaattagaacatagattggagtgaggcat

SEQ ID NO: 3066 - DNA, 373 bp; double-stranded, linear
tataaagaatcctgccttacctaagaacacttgtcttgtcgttaagactgactctagactcttatgtttattatcaaccgttaataaacttaccatcaagagtgcacctacccatactgacagtgcagtatagaatggtgtcatacctgaaccataatccttaactgggaaaacatcaacagtcttcttattaatagattgcaataatacccgctgctttttcaaatcattctantggtcgattaattgtcgacgcatcatcttgtcaattcttgaaatttattcgcttttcaactttcacacagcaattattgagaaaacgctaatcgataagctntcgctgngcgatttattagtagccacgctgacatac

SEQ ID NO: 3067 - DNA, 311 bp; double-stranded, linear
ttcagagttcggaacataaggcgctacaatgttgtgttgccagtagttgactgaatatgcgtttgtaacaagcttttttcgattctagtcaacagtaattaaatttatgatatgggcaatactttgtaatactaatattaaatggcgactttatttcactatgttataagagtgccatttgttgataaaggnatactaaagggtatcgtttggaattttagtaactagatatgttcgggtatagaccgnattgtggatacgtaaatttaatgcnatgaattttaaaatgaaaacatgacattaaatgaatc

SEQ ID NO: 3068 - DNA, 275 bp; double-stranded, linear
tatgattatctagtaagtaaattgctgacgcgccgaataccgcaaagaatataaagcaaactaacgccgggacaaaaagtacacctaggaataaattctttaatcgtacgtccttttgacacacgtgcaataanatacctacaaatgggtgcccaggntatccaccatggcccagtaaaagattgtccaattttgtaaccattgggaatttttgaccacctgtcggaatgcgtaaactcatacttaaagaaatttgcattataattacctagacc

SEQ ID NO: 3069 - DNA, 321 bp; double-stranded, linear
aaatgggttctgtgacattaacgtctacaaaagatggttcagaagaaacacacgaggctgatggtgtattcatctatattggtatgaaaccattaacagcgccatttaaagacttaggtattacaaatgatgttggttatattgtaacaaaagatgatatgacaacatcagtaccaggtatttttgcagcaggagatgttcgcgacaaaggtttacgccaaattgtcactgctactggcgatggtagtattgcagcncaagtgcagggaatatattgacattaacgatcagcctaantccgagcngattagatgtgagcgg

SEQ ID NO: 3070 - DNA, 400 bp; double-stranded, linear
gtttgacctgcatatttgacagtcataacctttgtatcaccattatattaatatcaaaatcttggaacgtgttatttgagntgacatttaacttcgcagcattatcagctgttgaacttgatgtatacgttgcgcaacccataactatctgtgttacaatgcaccaaacgcacctccaccagctacattagatgggcagcttcgccttgcagctgattggtttagatgattgtgatacgatccaatttgaagccaaatngtacttaagcacaatcctactgcggaccgtttaaccctgtttcacctatacactgntgaaaggcaaaccgtaccactcaccatttccatgccttccatatttggttaccaaatttacttttcccngaaaaatgaaactctt

SEQ ID NO: 3071 - DNA, 266 bp; double-stranded, linear
tggccatttgtcattgcatttttaccgtgggtgttgattattattccttacttactatttaaatcggatacactaaatattattcatacgggtgataatattgcacgaggtctaggtgtaaggttaancagagaacgtttaatattattctttatcgcagtgatgttatcatctgctgctgtagcatagcaggttcaatttcgtttatcggattaatgggtccgcatattgccanacgtatcgttggaccacgtcaccagttgttt

SEQ ID NO: 3072 - DNA, 319 bp; double-stranded, linear
gactccctgcaggtcgacgtctagaggatccccccacagcaattcacttatacatgtaacagtgtgaaataataacgtcacaacggcataatacacattgcaacgtcccaacaacatatcatagaatcgtaacggcatgacatcaacaccaaacctgggctataacaccataacagcgcaacgccacatcataggcactacatcaagtcgcatcgtagcaccagcacatcaaagtaacatgggcatcaacatcaaaccggtctataacaccataacaccggcaatgccacattcataggcactacatcaagtcggcatc

SEQ ID NO: 3073 - DNA, 282 bp; double-stranded, linear
atatacgcttatcagctggagctcaatagatggaggatgattatggggctaccggttctgtctatagcactggtctatcagctatgtggattacaatcggtttaacattaggtgcttatataaattactttgttgttgctcctagacttcgtgtttataccgaattagctggagatgcaattacattaccagatttctttaaaaatcgtttaaacgataaaaataatgtgttaaagattatttctggattgattatcgtagtattctttacattatatacnn

SEQ ID NO: 3074 - DNA, 396 bp; double-stranded, linear
tgtaaatactgaaactggtgaaattgtagttgaagaaggtacagtgcttgatcgtcgtaaaatcganaaatcatggatgtacttgaatcaaatgcaaacagcgaagtgtnttgaattgcatggtagcgttatagacgagccagtagaaattcaatcaattaaagtatatgttcctaacgatgatgaaggtcgtacgacaactgtaattggtaatgctttccctgactcagaagttaaatgcattacaccagcagatatcatkgcttcaatgagttacttctttaacttattaagcggtattgggtatacagatgatattggaccattaggtaaccgtcgtttacgttctgtaggkggaattactacmaaaccaattccgtatcggtttatccaaga

SEQ ID NO: 3075 - DNA, 376 bp; double-stranded, linear
acctacatttgcagttgtcggtgtataaccggctggtgttgaaaactctacactataagttccattgcttaaaccagtgaactgatatttaccattttcatctgttgtcgtacgatctaattctttaccgttactatctttaagaatgacataaacacctttaatccctttttcattggcatcttgtttaccatctttatttgtatctcccatacatagtcacctagattatattcntttgggcgccatagcagttgatgagcattcacattgaaaaactattgaccactatattagtttgcagtgctaagnataacatttccatacgtgacatactgatagactgtgagtgatgtatgcgctgntgctcataacg

SEQ ID NO: 3076 - DNA, 331 bp; double-stranded, linear
ttacatcaccaattagacgttatcctgatttaacagttcatcgtttaatccgtaagtatttaattgagaaatcaatggataacaaagaagtgaagcgttgggaagacaaattgcctgagttagctgaacatacttctaaacgtgaacgtcgtgctattgaggcagaacgtgatactgatgaattgaaaaaagcagaatatatgattcaacatattggtgatgaatttgaaggtaatgtcactcagtagctaacttcggtatgtcattgaatgccaatacgtaggaaggtaggtcaatgcgaangcngngatatacgtttgaggcgcaatgc

SEQ ID NO: 3077 - DNA, 345 bp; double-stranded, linear
aatcatatgcatcgatttccagcaacagcaaccattcatcctatgtcccattagcaaattttttggatgaaacatgaatggcaagatgtatttcaacgtactgctaatttgcagatattaaaacatacntttctatcattattgatacatatatcatgattattcatggcttccgcaacaggatgtttatttagaaacattagattgggatgttgaggcatagaactgctgggtatttccaaggaaatgttgccggaattattccaacaactattgatgtaagtatgaaagaacgtatgcaacataatgggctaataaagtacaccgtntgttaatggtgcnatg

SEQ ID NO: 3078 - DNA, 400 bp; double-stranded, linear
gattatcaagcgattgatcaagtatcatcattgttgaaagaaaaatatggcattgcacattcaacgttgcaaattgaaaacttgcaattgaatccattagatgagccatacttcgacaaattaacataaataaaacattgtagcgcctaaaacattaatctatgtcataggcgcacgtttcgttttatacttatgttgcatcatttaaatgattttcgtcaatttctttgatgctatctacatctaacacgaggttaacttgcgttgattttgataaagtgatcatagcttttagtacttgaggatttttattgttgctgttacgaatgtggtcatgtttaatgcgggacagtaatttaagttgtttttttacaattgagagtgtgatatttcgattcgg

SEQ ID NO: 3079 - DNA, 319 bp; double-stranded, linear
aaacgtttaatatacacttttacacgtcgccttcattgaagcgaattgccataaccttcacattatatatagttctttccatataaatgtccaaatttttagaacaacgcaatarataaccatccacctaacttatcaaaaatttaagtggatggtttttcattttcatttatatttatattagtgttaatccaatcatagatttatctatatgcactgctctatacatttcctcatttaatttgcyttactttcatttatatcattatcagaacacttggcgtgtcatcgntattatttcgcatctttganacgttta

SEQ ID NO: 3080 - DNA, 285 bp; double-stranded, linear
tcaaatgcatctaggncacattattctatttgggcattcttagtgctgttcttatttgcggctttaacgtcatctatttctttattagaattaaatgtttctaacttcacgaagaatgacaatacaaaacgtaaaaaagtcgcagtgatcggtagtattttagtatttatcattagtattccagcaaccttatcntttggtatcctaaaagatgtaagatcggtgcgggaacgatttttgataataaggattccaccgttcgaatgtaatgaagccataagcggg

SEQ ID NO: 3081 - DNA, 400 bp; double-stranded, linear
atcatagcgtttctcctaaaaattacgattaatcaaagtatgccattatttaactttagtttcttcagaattatttgccccattatcatgtttttcttctttattaacagcatttttatcatttttaacaagatacaatttaccaattaatgggcggtgtgcgtgctggtatgggttatactggttcacacgatttaagagaattacgcgaagaagcacaatttacacgtatgggtcctgctggtttagcagaaagccatccacataatattcaaattacgaaagaatcaccgaactactcattctaattaagataaaggagaacgacaaatatgggaaatggcaaaggaccaagagttaatccttgtcttaggactttggtaggccattacacccatta

SEQ ID NO: 3082 - DNA, 248 bp; double-stranded, linear
tgaatttgctccaaataaaaatacaattgccattaaaatcaccagatattacaagtggcaacatgttagaaacaccgttcattaagtgtttatagaatgctttacctgggcttatttcttgactgtcatttgagttacctggcaacaaaaggtttacgacttgtatctaatgaataccatctgctactggtncttctacgacatttttaccatcgangcggtccgtctcaacatgtacatcagcagca

SEQ ID NO: 3083 - DNA, 368 bp; double-stranded, linear
tactaaaggtttaaatcaaaaatggctaggtatcgtatttgcgattttaattacaattacatttgcatttgtatttaacacagtgcaatctaatacaattgcggagtcgttaaatacgcaatataatattagtccagtaatcacaggtattattttagcaatcgtaacagctattattatatttggtggtgtacgtagtattgctacgtatcctcgttaatgtaccgatatggctatcattacatggtatggtttagtaataatgctattaatttagaccaattgtccnatgataggacgatataaaaggcattggnacgacaagnactggtgcgctgagggctcggtctccaggacaacggggtatc

SEQ ID NO: 3084 - DNA, 256 bp; double-stranded, linear
ttggactttataaagttactaagttgtagattatcctggtaaagaagatattgcggttgtacaagttgaagaaaaatcaacacaaccaaaaggtagaaaattcaaagatttcactagtaaatttaatatagcatcagaagctaaagaaaatgaacctatatcagtcattggttatccaaatcctaatggaataactacaaatgtatgaatcaactggtaaagtattatcagtgaatgggatatagtgnatcggatn

SEQ ID NO: 3085 - DNA, 311 bp; double-stranded, linear
atatgcatatgcttctttaggtgaacgaatatctggttcagatacgatttcaattagcggtgtaccttgacggttcaagtcaactaatgaatactccacctttatgtgttgacttaccagcatcttcttccatgtgaagacgagtaataccgattcgntttgtttcaccgtcgacttcgatatcgatatatcccatttcaccaattgggttgatcaattgagaatttgatagctttgggatatcgggatagaatagtctacggtcaactagatcnggtgcgantccatatttagtgccatgcagcacgcat

SEQ ID NO: 3086 - DNA, 271 bp; double-stranded, linear
atgtaaatgatcatccttcataataacaacgattactgatcttgatcatgattttgaacaataacaactgctttattaataccttgtatacgctcgagncatgccaacctctgacaactcaatcctaaaccctcgaatcttaacttgtttgtcctttcgatataaataatctatgttgccatcgggtaacaaacgaacgatatcaccacttcctatacatcagctgatttatatttgaatctttgataaatttatctgcngtcaattctgg

SEQ ID NO: 3087 - DNA, 256 bp; double-stranded, linear
gtaaagatttcaattcatcatctttaaataaacttaatggtaattngttataccnaataaagccttctggacacttcctttagaccgacgaccgtcttagctaatgtcgatttccctgaccctgattcaccgacaatgcctaatgtttcgccttttctaatagccaagttaatatcataactgctcggtatgggctgcccctcggtgatgtgtaatccacgctccacgcgatcgattttaataaaatatcatggtt

SEQ ID NO: 3088 - DNA, 337 bp; double-stranded, linear
aaggttatttgaatgatcaaggtatccacaaaagaggtgctgaaatagatcgactcgttaaaggatgtacaggtgttaaacgtacaactggacagcatccagggggtattattgtagtacctgattacatggatatttatgattttacgccgatacaatatcctgccgatgatcaaaattcagcatggatgacgacacatttgatttcccttcctntcatgatatgtattaaaacctgataaacntggacacgtgatcccaccatgatcgatgcctccagattatcaggaatgatccaaaaccatacctgagatgtaagagtatcagtattagacnc

SEQ ID NO: 3089 - DNA, 303 bp; double-stranded, linear
tatcagcgatgacaattggtaaacaaatgcaattcttcggtgcacgtgcgaacttagctaaaacattactttacgctatcaatggtggtaaagatgaaaatctggtgcacaagttggtccaaacttcgaaggtattaacagcgaagtattagaatatgccganattcaagaatttgatcaaatgatggattggcctagcaggtgtttacattaactcattaaatgtatnactacatgcacgataatacagctatgacgattgaatggattacatgtacagaattgtccgnccatggcacagga

SEQ ID NO: 3090 - DNA, 400 bp; double-stranded, linear
ctttcgttaaaggggcatattcatataatggatggtcattaataataattcctgccgcatgtgtagatgtatgtcttggtaaaccttctaactttttacaaatactgaaccagcgttcatgtcgatggtttcgatgtacaaactctttaaaatcgtcaatttgatatgcttcatcaagtgtaattcctaatktatgtgggattaaacttggaaatttcatttaatgtaacttcatcaaaccccataattcttccaacatctctagcaactgctcttgcaagcagatgaccgaaagtcacaattccagatacatgtagctcgccatatttttcttggacgtactgaatggaccctttctcggngtgtatctgcaaggtcaattttcattntcaggcatggt

SEQ ID NO: 3091 - DNA, 340 bp; double-stranded, linear
ttgttttttcacgttcaatnattatcttcaacttgtgactacagattttaaaatggaatttacaagtatcttcttcaatattttgcatcatgatatcaaataattcatgaccttcattttgatagtcacgtaatggattttgttgtgcataagaacgtaagtgaataccttgacgtaattggatccatgtgtcgatatggatcagtccaatggctatcaatagaacgaggtaaaatcatacgctcaaaccccatccattggntcctctaagataccttttgaccttggatagcngctcaacctagcccaacgacctcgaaaatactcagcaccttacctt

SEQ ID NO: 3092 - DNA, 400 bp; double-stranded, linear
cgacacctcaataatcatatcgtaatgttcaacttttcctgatttaaatgtaatttcatttccattgatagcattaatttcctcatttaaacggtatggaatctcccgcttatctaattcatcaagtataggttgattcagtcggcatccataatttatttatcttatcagatcgatgaataaagtagggtgtaaaccacgttccataaagatttcaaggaactccaatggaacataacctgcacctaccaccaatactttatccacttggattggcttggaggaatggtcggataggcatccagggcctccaaaattccnaggggaaanggtaatatccaccttccaaggccaagggccaattggcacctggccacccagggncttaaaaaggggttaa

SEQ ID NO: 3093 - DNA, 252 bp; double-stranded, linear
ttatacccgncaaattcataaatatagtnccttttcaatagattgatatgtatgtctaaatgtatcgattaactttgctaatgctgcttcatctaatggtcggtctgctaattttaaaaatgtattcttcaataggtattcccatataatgcgttatttctttagatgatggttccgttaagccacatgctttaaatgcactttgtgttgctacttcaccacattttttcgtgtctgccaacgtaccatcaa

SEQ ID NO: 3094 - DNA, 314 bp; double-stranded, linear
aatctattaataatgaagaaaaaattgtactagcacgtagacggttaataaagttcgataaagatatcagtattccatatattctaaagcaagcatattctaaagaaaaaaacagttatatattcttgttagaatcacaagattctatattcttttcacaaacacctgnncaattaataaaggtcaataataaaatctatcgactaaagctgtgcaggtcaattaaacggtcacaagtgaggccgaggtacaaaaaatgttgagcattttaaagtataaacttatcgacacgnttgtgtgcagttttcatgttt

SEQ ID NO: 3095 - DNA, 332 bp; double-stranded, linear
ggtgaggcggcattgagaaaaaatgctgaagtaatcgaagctgtatcgcagtcttgtttgacaacaggattttgtttatggtgccaattagctttttcaacgtatttagaaaatgccacgcagccacatttaaataatgacttacaacagcaattgttatctggagaaatattaggtgctaccggattgtctaatcccgatgaagtcatttaatggatttagaanaagttggaccctttgaaacaccaccttaatgttggatgggaccaattgggtggtccagtgggancgtaatgcccagctgtaaagtnataatccaaggaaagacccat

SEQ ID NO: 3096 - DNA, 400 bp; double-stranded, linear
tttatgcatacgcgcactcatcacactaccgacaacaacatcatcttttcgagcatatctacttaacaacgtcatgaccacactcataaagaacataaaatcagtaatttgatgcttttctacatacttttgaagtagctgtctcatttgttgattcatgtaaatgacatcatgctccatttgtcggtttaataattggtctaacatantctgtcgggtaagcctaaaatagggtacttcatccttgaattgaggatacccatattggtcctaaggttcggtccatatccacggatggcggaccatcccactccacctaataggtcctttaatattggcaatttaaggtgggaaccaataatttaaggttggataaaggtgccgttaaggatccaattcc

SEQ ID NO: 3097 - DNA, 265 bp; double-stranded, linear
actctggtccttctgcataactgccgtaaataattcaccttcatcacacgctgtacctaccaataatcccncacgatatacgtggaattcgaggtgtacggtagaaatacttcaccaatgatgcacttacaattttaaatagatttttaagaccttgttggttttgtacaattaatgtgacatgactaggtcttgcacgtttatatgcatcttcattactgagttttttggttgatttncgttatgatttaatacggctaattct

SEQ ID NO: 3098 - DNA, 321 bp; double-stranded, linear
ctaatgtatcagtttggcatgaattcttttgcatctttcaataattgttgtgatcttttttagtcacatcatcaattttcttatcttcgtataatgctttttcaatcttatgatatcctgaccattctttttcctttttctcttctttcatatctgcaagcgggcatccaattttaggatcctaaatctcccaaatgcttctgaactggtcagagcgtcataatacatacgacttttggatatacgcttttncttgggcatacattatttcaatcgtttacaaatttttctgaccttttaaaatcattnactgtcancaga

SEQ ID NO: 3099 - DNA, 276 bp; double-stranded, linear
atccgcaatctgagaaacatcatcttcgagttgttggagggttccaattttcaagtcataaatcagatgatgaatggcgagagtttggactaaatcattttgtattacctgaagttttaatttcaactgataataatgggacatttttaacttatacagttaaaagggaaagttttactgttgaggcattgaacgatttaatggattgttcaacaatatatcggacatagagtggacgaccaatgggggaataccagaatgagatattataaaaca

SEQ ID NO: 3100 - DNA, 237 bp; double-stranded, linear
gtcatttgatgacaatggtattagaccaagtaccaaccgttctgtgccacntaaaacgttgttaataacttgccgggcttcacactaatcaatggtggcaaagtaggggtgtttagtcatgcaangttaagaacgagcatgtttgattcaggagataataagaactatcaagcacaaggaaatgtaattgcattaggtcgtatacatggaactgatacgaatgaccatggcgatttt

SEQ ID NO: 3101 - DNA, 254 bp; double-stranded, linear
ncgatataacaaggttgttagacttaaaggtggcgatccagcgatatttggtcgtgtgcaagaagaagtcgacatactaaatgaacatcatattgcgtttgaaattgtaccaggggtgacatcagcgagcgcnagtttggctactatgcagacaggtttgacaatgcgtacagttgctaaaagtgtggacattttctacaggtcacttttaaagattcagaagaaaatgaagtgggatggtccattccttaagt

SEQ ID NO: 3102 - DNA, 240 bp; double-stranded, linear
caatcactcatgtagtaattgatacctaagaagtcgtttaaatctttggctgcatctaaaatggcataatcttcatntgtaatgtttaatttaccgccantaacagataagatatgttgcacaccttccatcgtttcacgagtaatacttacctaaatatgttgcatctaagatgaatttattatggatggatatcttctaaattctgctgcacgggacatcttcaggatttggatggtt

SEQ ID NO: 3103 - DNA, 328 bp; double-stranded, linear
gttgtaaacttcaattgttcaaataaataacacatatcattggaggtgaattgatatgccagattcaatcacaattatagatgaaaacaaagtggttgatgttgtattaattgcaggtagaattttacttgaatcaggtgctganacatatcgagttgaagatacaatgaaccgtatcgcacatagttatggtcttcataatacatatagttttgtcagttcaactgcaattattttttcattaaacgatcgaacaagtacaagattaattcgttacaagagcgtacaacagatttagggaangtgcgaataagcggggnaattcttc

SEQ ID NO: 3104 - DNA, 265 bp; double-stranded, linear
ttttgctttgtgcgctaataatctaatgttcgtggaaccgnaaccagagatattacaaatacatcatcgactaatcgcaggtgtcgttgattctccaacaacatgtgcctgtttgccgagctgatttaaggcggcattgcaaaactattcgccacgaatcctgaacgtcctttgccagctacaaatatatgttcagcatgtagtattttggatgcaaagttgaaaactcatccgcttcaacatgtgacaaagtcactttaatcna

SEQ ID NO: 3105 - DNA, 243 bp; double-stranded, linear
actagtagagtatctaatggtgatttaatcattattactgctggtgtaccaactggtgaaactggaactactaatatgatgaaaatccacctanttggtgacgaaattgctaatggtcaangtattggacgtggatcagttgttggtactacattattgctgaaactgttaaagatttagaaggtaaagatttatctgacaaattgatcgttactaactcaatcgatgaaacgtttgtgacct

SEQ ID NO: 3106 - DNA, 234 bp; double-stranded, linear
ctattgcgtttgggtaaatctaaagcaggcgtanattatcaaagtttgggatatgcaaccagcacacttattctttatgattgcagcgccagaagtggngcccaaacacatctagatgctttactaagttgtctggtattttaatggatgaaaatgtacgtgagaaattattacatgcttcatcacctggaagaagtactagcgatcatagatgaggctggatgatgaagtgga

SEQ ID NO: 3107 - DNA, 227 bp; double-stranded, linear
ttttgaagcggcataatcatgaagaataggactaggattataaccttgtacagatgatgtcgttgtaattgacgcacccggttttaaatattccaatgactttttgaactgtccaaaatagcggntaganattcgtttcaaatgtttctgtaaatgcctcagttgtaaatccatgaatatcatcatgatactgttgatgtccagcaactaaagtaacattatctaag

SEQ ID NO: 3108 - DNA, 257 bp; double-stranded, linear
ctttaagttacgttcggctttgattaaagtaaaacgtggtactgtttcctatgacaagagtctaattggatacaatgtaaacaaaatggtgnatttgtattatagataataaacattcgntatacattcaacatatcgatgaccacttggattaagcaacgtaatatcattcgtactgctcaagaaatgacaaacgaaatacgagaaaattttgagtcatacacgtcatttagaatgaatagtattatgcaagtact

SEQ ID NO: 3109 - DNA, 227 bp; double-stranded, linear
cttaaagccaagtcgatctgctaattttgcaagtgtcactgaatcttgcaatgccttttgtgcatccttaccttcatctattaaggcatagtctaatacgcttaatttaaccaatccgtcatctccaaacttatcctgtcatgtcaaaccgacataacatttgtagcgttcttaataccattccctctgcatatacccacgtatatgataacgtntttcanttaact

SEQ ID NO: 3110 - DNA, 326 bp; double-stranded, linear
tttcttcatcgtttgtgagaaagaggtatttttaattgggaaancaggtaaaaaggatggaagtacataaaaagagcaatgcttgggcattattccncttgttattatttgtggcgttgtttttaggcgtagtattatcacaggtgattttacttcaatgccattaaatgttgcaattacgataacgtaattgtgcgttattaatgaatcgaaaagaatcattgctaaaaagtgagtctccgaaaggcggccttcaactgttaagagtgatttattgcaggcttcaatcgcgaaatggtgcnaagcgcgtattagcactagccgaa

SEQ ID NO: 3111 - DNA, 300 bp; double-stranded, linear
ctacggcgccttgcatctttcccaacaattaaccccaactctattagcacagatttatcaattgattcataagcttcatcaaagggtgaactaacatgcattaacgcttctttaatatcaattaagtcggcatgttcaacaccaattttcccttttttatttttagctttttctctatcaatatacgcatgtttaacacctttgacatgttcagtaaattgtgacttcctnaattttttatcctcccttggtgnnggggggggggggggggggggggggggggggggggggggggggggg

SEQ ID NO: 3112 - DNA, 358 bp; double-stranded, linear
ttattgttaacacaaggnttcgaacaaggttggtttagtacattttcaatcatttgtctgagcatttttatcatcactacgttgatattcatcatcatcgaacgtcgacatgaagtaccttttattgatttctcagtattacgcaaccgtccgttcattggtgcatttttaaataactttgttttaaatagcggtctagcgtaacagggtctttcatatatgctcaacacacctggtttatcgcgcgcaatcggactgttacatgccaatgccatgggcgttcgagatcgttagtgaaagcacatagttcgggcaatgagccacatggtcgtgtccgtcacgcacacatatagcagct

SEQ ID NO: 3113 - DNA, 251 bp; double-stranded, linear
tcggtcttgaaaaccgacaggggacttaacggctcgcgggggttcgaatccctcttcctccgccatcaatatttatattaaattctatatataatgaaggtaagtgctcaaattttgagtatttaccttttttatttgtctttgaatggctcgtaatttttgataatagaaatgataaggcattgagattggaagggcatttggcttgtgcaanatacatagcnaaatgtcgttgttgttttgtgatagat

SEQ ID NO: 3114 - DNA, 6591 bp; double-stranded, linear
tttaagtgaattnctttgggttacagaawtttcaacaactttaaagcacgtataatgatgattttcagcttgtacaaaggagaaaaaaagaagacaaccaagcccaataatggactggccgcctaataataaaaactctaaaagttgtattttaaaaatagttctttaaattatatacccaccacatttggtggagaaccgttaaacaatgcatagttgcttaacttccaatattgaactcatcattacaatttgacatagagtctattaaagcgtgtgccatttgagtccacttttatttgtattgtatagagagaaataaaaagaaaccttgttttacaaggtttctaatacgttatgttatgtaaataacagttaattataccggtggtcggggtcgaaccgacactccacaagtggaacgggattttgagtcccgcgcgtctgccaattccgccacaccggcttaatggtaaacaaaaaacttccctttggaagcaattatggagcggaagataggatttacacctatacctcgttccgggaaggaacgtgttctaaaagttgaactactcccgcaaatattaaattatggagcggaagataggatttacacctatacctcattccaggaaggaatgtattctaagagttgaaatactcccgcattattattaaattatggagcggaagataggatttgcacctatacctcgttccgggaaggaacgtgttctaaaagttgaactactcccgcataaacctggaggcggcaaccggatttgaaccggtgataaaggttttgcagacctctgccttaccacttggctatgccgccaataactgggctagctggattcgaaccaacgagtgacggagtcaaagtccgttgccttaccgcttggctatagcccattaataataagggcggctgaaggggatcgaaccctcgaatgtcggaaccacaatccgatgtgttaaccacttcaccacagccgccatggcaggggcagtaggaatcgaacccacaccaaaggttttggagacctctattctaccgttgaactatgcccctattaaaaataataaatggaggggggcagattcgaactgccgaacccgaaggagcggatttacagtccgccgcgtttagccacttcgctacccctccataaatggtgccggccagaggacttgaacccccaacctactgattacaagtcagttgctctaccaattgagctaggccggctaagaaatggttcaggacagagtcgaactgccgacacatggagcttcaatccattgctctaccaactgagctactgaaccataataaaaatgtaatgatggcggtctcgacgggaatcgaacccgcgatctcctgcgtgacaggcaggcgtgttaaccgctacactacgagacctataaaatattgcgggaggcggatttgaaccaccgaccttcgggttatgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaaccgctacactacgagaccattagtaaaacggaggaagagggattcgaacccccgcgagccgttaagcccctgtcggttttcaagaccgatcccttcagccggacttgggtattcctccaaaattatatggacttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacggtgatcactcaccgcaggattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaaggcgctagatcctaagtctagtgcgtctgccaattccgccacacccgcaaatggtgagccatagaggattcgaacctctgaccctctgattaaaagtcagatgctctaccaactgagctaatggctcttccatggtgccggccagaggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgnattttgctcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttnaggattttcagcacttatcccgtccacacatagctacccagcttatgcnttggcacgacaactggtacaccagaggtatgtccatcccggtcctctcgtactaaggacagctcctctcaaatttcctacgcccacgacggatagggaccgaacttctacgacgttctgaacccagncstgtaccgctttaatgggcgaacagcccaacccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaacctttgagcgcctccgttaccttttaggaggcgaccgccccagtcaaactgcccgcctgacactgtctcccaccacgataagtggtgcgggttagaaagccaacacagctagggtagtatcccaccagcgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtagcttcgcagaanctarccactcctcttaaccttccagcaccgggcaggcgtcagccctatacatcaccttacggtttagcagagacctgtgtttttgataaacagtcgcttgggcctattcactgcggctcttctgggcgttaaccctaaagagcaccccttctcccgaagttacggggtcattttgccgagttccttaacgagagttcgctcgctcaccttagaattctcatcttgactacctgtgtcggtttgcggtacgggcacctattttctatctagaggcttttctcggcagtgtgaaatcaacgactcgaagacacaatgtcttctccccatcacagctcagccttaacgagtaccggatttgcctaatactcagccttactgcttagacgtgcaatccaatcgcacgcttcgcctatcctactgcgtccccccatcgattaaaacgattataggtggtacaggaatatcaacctgttatccatcgcctacgcctgtcggcctcagcttaggacccgactaacccagagcggacgagccttcctctggaaaccttagtcaatcggtggacgggattctcacccgtctttcgctactcacaccggcattctcacttctaagcgctccacatgtccttacgatcatgcttcaacgcccttagaacgctctcctaccattgtccaaaggacaatccacagcttcggtaatatgtttagccccggtacattttcggcgcagtgtcactcgactagtgagctattacgcactctttaaatgatggctgcttctaagccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttgaggctagccctaaagctatttcggagagaaccagctatytccaggttcgattggaatttctccgctaccctcagttcatccgctcacttttcaacgtaagtcggttcggtcctccattcagtgttacctgaacttcaacctgaccaagggtagatcacctggtttcgggtctacgaccaaatactaaacgccctattcagactcgctttcgctacggctccacatttactgcttaaccttgcatcaaatcgtaactcgccggttcattctacaaaaggcacgccatcacccattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaggatccactcaagagagacaacattttcgactacaggattattaccttctttgattcatctttccagatgattcgtctaatgtcgtcctttgtaactccgtatagagtgtcctacaaccccaacaagcaagcttgttggtttgggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacactagcgattatttcttatgaattcaagcttatttaaaactctttattcactcggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactagcgattccagcttcatgtagtcgagttgcagactacaatccgaactgagaacaactttatgggatttgcttgacctcgcgggttcgctkgcctttgtaatgtccaatgtagcacgtgtgtagccaaatccataaggggcattatgatttgacgcatc

SEQ ID NO: 3115 - DNA, 325 bp; double-stranded, linear
ggtgccaagcaataaatatgactatgctcaaactgaattaatggtgggtgtgtcgccatcgtaattggatcgtctgaaggcgcatataaatgatagtgctcttcgaataaaggtagcatatgtaattgtttgtgtttacgtatttctggtgtaagttccgtgaaaccaatgtctatattcccattaatacgctattataatgtgtcaggtccaataagccccggatgacatgtgtatccatttggaaatggaaccgttgggaaagtgggaataacatgggggaacgtcantccccnccaagcccatngaggtacctttaatttta

SEQ ID NO: 3116 - DNA, 211 bp; double-stranded, linear
ccgnttgagttcggtggcgacatgattgattttgtaagtaagtatgatgcaacatgggctgntttacctactaaatttgaggcgggtactccattaattgctcaagcattgggcttgtcagaagctattcgctatttagaacgcataggttttgatgcaattcataaatatgaacaagaattaacgatatatgcttatgagcaaatgtctg

SEQ ID NO: 3117 - DNA, 210 bp; double-stranded, linear
aacgtnttttgaaatgattgcggcgatgttggcgacagttaaagtaggtggcatcttatatacctatcgatattgattttccgaataaacgacaaggtgcaattttggaggatgctaaagtaactgcagtcatgtcttacggcgttgnaattgaaacgacattaccagtcattcaattggaaaatgctaaaggctttgttgaatcaaagg

SEQ ID NO: 3118 - DNA, 225 bp; double-stranded, linear
ttaattgatcctagcttggtttgcctctgtcactttatcattgatattttggacagttgggttgccattcaacacttgattaatttcagttaacttttgacgcgctgcttgtaatttttgggtgtacgcatttaacgaacggncgtcatacctgttgtatccgttggttgattaatgcttgttctaaattgcgtttccaagtttnaagcggcgcttatctggtgt

SEQ ID NO: 3119 - DNA, 222 bp; double-stranded, linear
ccaacatgatgctagtttgattaagtttcttctaaacagacttcaaacggcatggtttagcatatcctattaaggttgaatcgcgttaacagcacataggaaatgctgttaggcgatgcagagtgcgattaggcagctactggaaaattattgtttgatttgccagttattataaactgtgtgtgttgatgncgancacaacccctccgaacacgcttaatg

SEQ ID NO: 3120 - DNA, 246 bp; double-stranded, linear
cggcgattatattaaaaagccaattacagaatgtagtggtaatgaaatatgccaagaatggctgtatcacttaggtgtatcaactgacaaaattgaagacttagcaaaacatgcatctaatacgattcctgtttatatgccatatatcacatcttatttcatggacgcgtgctatcggcgnacagaccttttagtcgtgcccggcatgcaatctncaggaacttaggcatttattggtgaactttg

SEQ ID NO: 3121 - DNA, 399 bp; double-stranded, linear
caaataccttctcaacnttgtactttttgcctaattgagctgcacgaattgctgcaacgtatccaccaggacctgctccgattactatagatctgtttcaattgggaaatctccaactaccatgttttacccctccattaataataattctggattatttaataaacgtttaatgtgattcattgcattttggccagttgcaccatcaatttgtctgtggtcaaagcttaatgakrtgctaatactggtgctgcaacaatttctccatctttaacgataggtttttgagcaatacggccaattcctaagattgctacttctggggtgattgataactggagtgaaccattgtccaccagctgaaccgatattactgattgtgcatnngcaccttncatt

SEQ ID NO: 3122 - DNA, 301 bp; double-stranded, linear
cagacaaaccttgaattattctacctataattaaaaatgctggcaaaggtgtaatgatgatgagtaatgaacctacaacatttaatatcaatcctacataagtaattttgacgcgaccaaatttatcagcaacatcaccagcacctacgtaaaccaaccagccaataaggcagataagctaacagcgtattatcgttcccacgtcactactatatgtggatgtatgggacacagtttaccaggctgcgcgatagccaagnataccctaacgtacccaagcacggtgcacnnaatgttgtgg

SEQ ID NO: 3123 - DNA, 378 bp; double-stranded, linear
ggagcaaatttatcatctgcaactagacacaacatcactgttattagtaccgggttatatagtagcagtcattgttggtgcactaagtggtaaaatcggcgaatatctgaattcaaaaccagcgattatcacagcaattatttaatagcactgagcttgatttacctgcattgcagtaggtaatcacattcaatctcgtcattctatgatatcttgcagtagcttgcttaatgatgcacttactacgagcataaacatgtctatatgcaggtgcatgttatattatatatggcgacgagatcgtnggccnacgttaactaattcngcatgtctagcctcgaattatatagtaggagcgtagtacgccaactgccacga

SEQ ID NO: 3124 - DNA, 251 bp; double-stranded, linear
tattgcaagaaatgaactgctgatttttatagttttagtggtcataaaatgcttggaccaacaggtattggcgtattatttggtaaacgtgagttactacaaaaaatggaaccgattgagttcggtggcgacatgattgattttgtaagtaagtatgatgcaacatgggnctgatttacctactaaatttgcaggtcgggttactcccattgaattggctccaagccaattggggcttggcnaggaagcct

SEQ ID NO: 3125 - DNA, 233 bp; double-stranded, linear
cggttaagtaatacaggatgttctctaattacttcttccaatacgtcccaaacttcatcatccatacgttcgattttactcttcgcatttttaatgttagttgcaatttcacgttgaactaattctttcattacgaatggtttaaatagttcaagtgccatttcttttggtaaaccacattggtaccatttccangcttggacccnacggcaattacctgaacggtcccggaa

SEQ ID NO: 3126 - DNA, 413 bp; double-stranded, linear
aatagattcccgggattcaaaagcatggatgttgtaccttgttgtnctccattggcaatgtactacctgatgtcaagatgaattatccatcactttgttgacgtgctttattttacagcatcaatttgatccaatcgaaataccagataacttagactgtgtcccagtaaaataacgatcaatcacatcatgagacaagccaatcgcttcaaatatttgtgccccttgataactttgcactgtcgaaattcccatcttagccattactttaatgacaccttctgacaatacatccgtatatgtcttaacattatcgacaacggtgccttgtaacccttctgtcaatgtcagttgttcaactgtacgttgcgctaggtatggcacaattgattcgcgccatatgcgagtaaaca

SEQ ID NO: 3127 - DNA, 209 bp; double-stranded, linear
gtcgtaaatactgaacaaaaatcacggcatactgtgcaaatttntgaagaagctcaaaaactattacaagcacatcatgcgattgtagaaggatatatcgaatcagctttagagcgtgcgtanatcatcttctacatacataggtaattttatggcgattcctcatggagcatcctgtaaaaagttttacaatcacatgtgcttatttt

SEQ ID NO: 3128 - DNA, 204 bp; double-stranded, linear
taaattaatggagtttggtacacgtcgtcgcaagaaattgatgcagtggggcgctagagctgcttacatcgggggctttgattctacaagtaatgttagggcggggaaattatttggtatacctgtgtctggtacacatgcacatgcatttgtccaaacttatggagaccaatatgtttgccttcnaaaaatatgctgaaagnc

SEQ ID NO: 3129 - DNA, 239 bp; double-stranded, linear
gaaataccattaatataatagtcggtaaattaagaaacgtggtgcgcgattcacaacagaaatcttaacttatcgaagtatcctgttttctctgcaacaccaataccaatcatcactgctagtactaagcctaatgcgggaactctgagaaatttttaatcgtattcttcttatcatcgtaaatccatctggctattatattttaatataanggtttgagctaccggatgctaacgnac

SEQ ID NO: 3130 - DNA, 259 bp; double-stranded, linear
atcacaataaacattttaaaattcttgttatcataatcattaaaaggtattaaccttaataatatattctctngtctcaaccttaatcgtatacttcagacgtctgtttgtagacaataaagtcattcacgtcttcatatgtcatcanatgtttatcatgatatgatgatatataatcggtatatactgtagatattacacataagagaggatataatatgaaaaggtcattaagatgtgctgagagctgtgtatcagt

SEQ ID NO: 3131 - DNA, 227 bp; double-stranded, linear
tgtgcctgccattttgcaatatcttcatcttcacgtggtaatgcacaaaaatgtttaccatgtgcattcacaacttcaaaaatatgttgacatgtgatgttacttgatcatcacgcgttgccatggtatgcaagtgctgcgataaatctgcggcaccttcgactatcatgctaaccttcgcttgtnnatatcgcaatggcataccccttcaacatcttctatcatgg

SEQ ID NO: 3132 - DNA, 203 bp; double-stranded, linear
atcgcagtgatgtnatcatctgctgctgtagcntagcaggttcaatttcatttatcggattaatgggtccgcatattgccaaacgtatcgttggaccacgtcaccagttgtattaaccaattgccattttagtaggggcatgtatacttgtaatagctgatacaattggccaaaattgtattacaaccaggtggggttccagc

SEQ ID NO: 3133 - DNA, 201 bp; double-stranded, linear
agcatttagtttagcggcagtagctgcagatgcaccggtagctggcacagatattacgaatcanttgacgaatgtcacagttggtattgactctggtacgactgtgtatccggaccaagcaggttatgtcaaactgaattatggttttcnagtgctaattctgctgttaaggtgacacattcaaaatactgtacctaagga

SEQ ID NO: 3134 - DNA, 207 bp; double-stranded, linear
catttgtaactgttattgtttataacttctgtgtgaagcgcaatattacaattaaaatgccgaaagaggtaccgncgaatatttcacaagtatttaggacttaattccattttcagcggtaatcatcattctttatgcattaggatttngtcaatcgcaaccagctttaaatcaaaatgtagcggaggtattttaaaattattcggt

SEQ ID NO: 3135 - DNA, 203 bp; double-stranded, linear
aacacctttaggtcgtgcaggtcaacctgttgagttatgtggtacttatgtgctattagcgtcagaaggaatcaagttatacaaccggacaagtnttcggtgttagcggtggagtgcaantaggttaggtttgtatgagcttttaattgagcaccataatgttaatttagttacttcaatccattaaattaaatgaattggtg

SEQ ID NO: 3136 - DNA, 211 bp; double-stranded, linear
cacatccaatgcantctactaaatcagacacaccacaatctccaaccataanacaagcacaaacagatatgactcctaaatatgaggtttaagagcgtattatacaaaaccgagttttgaatttgaaagcagtttggatttatgctcaaaccatggacgacggttaggtttatgatgttattccaataggttcactataaatagcttagtt

SEQ ID NO: 3137 - DNA, 260 bp; double-stranded, linear
attgggaaatgttcccccaccacctacaatttgtgaatacaaacaatacgtattgcaatggactttacctgggcttaccaagtgaatgtatacgtcacgtatgatacgattgtagttgnaaaataatgcgaacagaaaatcgttataagtacaaataatacaggtgactcaactcctgcttttagattaacaaatctccaaccgatacaatgagtgcttgcaacataccaagcattataaagaatcctgccttacctaag

SEQ ID NO: 3138 - DNA, 212 bp; double-stranded, linear
cataagcaattaatgacttcgttaattgcgaaagtgtatctttttgattatcattcgcttttgcatcttcaagctttctcacatctgatttgacagcattactttcactattatcttcaagcgataatttcttaactgcacttaccacttgctcaattgcttctgcntattgtcattcgatatcggagtagtaggaagtgcngaattcggca

SEQ ID NO: 3139 - DNA, 373 bp; double-stranded, linear
tattggtttttatgcgaatatggataataaaaggtctcacgacatcattgataaatcgcttganatgttgcgacgcttagatcacaggggcggggtcggcgcagatggcatcactggtgatggcgcaggtattatgactgaaataccttttgcatttttcaaacaacatgtaacggaggacctgaagcgcgtggctttatcattggctgtcctgtagcttattcaatggggattggctttgcacctgttagaaaagaagggaaattacctcgtgaagtcattcgttatgagtatgacctagaatatggtacaaatgttttaacaatggcacaaagatgcaattgaaaccaggtncaacgtgtgttantacagg

SEQ ID NO: 3140 - DNA, 220 bp; double-stranded, linear
agccttataataaagtgcctttcatagcaataagttgtgtccattgacctattacatttttcgttttgtacattaaatataagaaatacggtgcaccaataattgctacgacaatacctgctggaacccccacctggttgtaataccattttggccatttgtatcagctataaccaagtaaccntgccccaactaaaatggcattgggtaaaaccacntg

SEQ ID NO: 3141 - DNA, 177 bp; double-stranded, linear
gaggagcagcacaaccaaatacacaaccagctggacaaggtgatcaagctgatccgaataacgctgcacaacacaacctggaaatcaagcaacaccggcaaaccaagcaggtcaaggnaataaccaagcaacacctaataataatgcaacaccggcaaatcaaacacagccagcgat

SEQ ID NO: 3142 - DNA, 204 bp; double-stranded, linear
cttttttagcatttggtttaacaaccnggtgttgcagtatccccacttaaggtctgtataccttgatctttgattctagtaacgccatcatcagtcgtttggtcaccaatattaccaattatttcatttttatgttcctcgataacttgtattgctgcttgttttcctccatctgtcaatccatcatttgattgagagaancag

SEQ ID NO: 3143 - DNA, 279 bp; double-stranded, linear
gtgatgccatataaattggcaataatggcacaagtactgtcagtccagcaatcgctataaactgactgagccataaaatgcgaaagttactgcgccatatagactgattaatcatatgtcaccattggatttggtacggtagttaaacctgaaggcatactaccctccacccacttattcaacgttggatnataggcaatgggtaattaaaaattttgtttttgaaatgggcccacgggcttgttttaatcaaaattaaaaaattgtggtncttggacc

SEQ ID NO: 3144 - DNA, 514 bp; double-stranded, linear
tgacttaatcaaagcatttgatcaaaacaccagaataccattattctttaatatgttgtacagtaaactctntattatttgttgctgttggatccattgttcgtctttcaacaaaaacntgacccagaatgaagtccgatagagtcaacaaagctatagtatttgtaaccatcttttagttgataaatgccacgcgcatctgttattgcgtcatttttaggtacaaattgaatttkgagatttctcacattatcaggtactttaaataaacgcaaagttggaccgncttcaacagtcttttcagcaatcgtatcattagtatcagcatttttgataataacatttgttgcgccttgaccgtttttagtagtcattgtattaaatcaaggttaattcagaattcggatttactgttaatgctttctcgataccattaaaatcgccatggtcattcgtatcagttccagtatacggcctaatgcaatacatttgcctgtgcntgatagtncttatt

SEQ ID NO: 3145 - DNA, 302 bp; double-stranded, linear
attcagactttgcatgtggaatggccacgttcatgccaatagctgtcgtactcccatttcacgttctagtattgcattttttaaatgcgatgtgtgctctacataacggcaaattttaagttttatgaatcaacatatccaatggcttcggtttcgagacatgtccgtggattcagtaattaaccatagtttggttggatccaaaaccatgagnagggtttaatggaggatgtngaatggttcnccggtggttaatcctacatggtccaccctcctggtaaccatggtggtggtaataaccc

SEQ ID NO: 3146 - DNA, 332 bp; double-stranded, linear
caggaataggatcatttgcatccatagcttcacttattttttcagaagctagcgtacaatcatttaaatctacgccaccttctttatcaatagagattctaagaaaatgatctctaccctctttgaccatattcaacgtctacaagttccaaaattcaaggtcttcccataattgggtttaaccaatccactttctacctggtttccggtaaatttttacctccataccagggncctcccccttttttgggccaaaataggaaaaangaggcgggggaaatcctccccccaattccnttcctggccctggaggtttccacctaaattttttt

SEQ ID NO: 3147 - DNA, 204 bp; double-stranded, linear
gagagtggttaacaagcaaatagaaataattaaaaatgcagatgcagatgcatcggcgaaagaaattgcacgtacggatttaggtagatatttgacagattngctgataaattagataaacnccaacaaatgcagaagttgctgaattccaaatgtaacgatacctgcccatgagcgatgtgctcagaatgatcagagctaatg

SEQ ID NO: 3148 - DNA, 217 bp; double-stranded, linear
caaccgggacaggtggggttattggacgttatttttggcctttggattttaagatattggtcgaaaagagattacataaaattgtggccaaatgcggattgcatattattgtaacgccgnctattgcattgttgattgttaggnctattaactatctggatctgtatgccattagccaggttttgtttcagacagtttagtttcagtagttaacgga

SEQ ID NO: 3149 - DNA, 174 bp; double-stranded, linear
ctattattatattccgcggtgtacgtatatgtgctacgttatcttcgttaattgtaccgattatggctatcatttacattggtatggttttagtaatattgctatttaatttagatcaaattgttcctatgataggtcacgattattaanagtgcatttggtcatcgaacaagt

SEQ ID NO: 3150 - DNA, 181 bp; double-stranded, linear
gggaccgaattgacttcagcattaccagcaaattgattaatnttgtgggctggtattggctctggcggtaccatttacaggtaccgcacgttattaaagcaacatcacgggcaatgttatgccgttgagccagaagggtccgtgtttaaatgggagggccagctcatgcactgacactgaa

SEQ ID NO: 3151 - DNA, 172 bp; double-stranded, linear
gttttaattgagcgacatactcttctgttagctctgctactttttaaaatagagcgattgacatcaaacataactgctaaacgctcaacgtctgccttcgtaatggcttttgtagaaattctaactaaataatttcgaatgctatcattggttgtntcaacagcttgatgct

SEQ ID NO: 3152 - DNA, 209 bp; double-stranded, linear
atggacgttgagacatttataagcgatatagatttcgcatgttgcatttattaaacctaataatggtaaacgacaagtgtgactgttactggactttaatgaaggtagtaatcagaatggaaatcaaccaaaagtaggtatttgaatnttgggaataatgagacatagcgagagtgtatatgcaatacgacagtactntaaattaagag

SEQ ID NO: 3153 - DNA, 174 bp; double-stranded, linear
ttctcacaaagcgctcagttgaagtaaatccacctggacaatccaaatgtacctgcttcattgcctaaaggttcaatcgttanaccttccaataaatttgctgttgctggataaggagaaattattggtatattgtcttaaattactatgatgccaatttaaggtctggatgat

SEQ ID NO: 3154 - DNA, 267 bp; double-stranded, linear
ggatcacatcgttcatttacacaatctattaatattcaatggcacaatatagtgtttatggcattacggatatgatttagtagcncaccattattaaccgatctctatctgttaaaaggaacttaagagcaatgtttgcgcatcatcattttatgttgcgtctttgcacgagttttgcgaaactttacaatatttgttgcggatgattatttaacttttggagaatgttgatggcacagtccactatancaatcagtatcgcaatgg

SEQ ID NO: 3155 - DNA, 490 bp; double-stranded, linear
aattaaaaatcaagcaactgctgcaaaaatgcaagatcaaactgttcctcaagaagcaaattctcaagtagataataaaacaacgaatgatgctaatagcatagcaacaaacagtgagcttaaaaattctcaaacattagatttaccacaatcatcaccacaaacgatttccaatgcgcaaggaactagtaaaccaagtgttagaacgagagctgtacgtgtttagctgttgctgaaccggtagtaaatgctgctgatgctaaaggtacaaatgtaaatgataaagttacggcaagtaatttcaagttagaaaagactacatttgaccctaatcaaagtggtaacacatttatggcggcaaattttacagtgacagataagtgaaaycaggggattattttmcacgagttaccagatatttactggtaatggagacgtgggattattctaattcanataatacgatgccaattgcagacattaaaagtac

SEQ ID NO: 3156 - DNA, 262 bp; double-stranded, linear
ccttcagtaccttgtaatagttanttaaatgttccgatcatcgtgtagtgtgattcatcataccggccttttcaattgaatacgatctaaaccgtttcgtcaggtgctagtaagttaccttcgccacctaaataagaagttcactcgttacgattttttcagatagcatcattggtggattcgtaacttgtgcaacagctgtttaagtattaatagtgattcggtcgtcttcacatgcattggcgcacaatccntgcaccgt

SEQ ID NO: 3157 - DNA, 170 bp; double-stranded, linear
atggtaaaaattgcactatctgctcgggaaacgattttgcataacctattgttaattttttacctgttgatttagctgtatctgnccattttttgagcttctgctgtcgttttagccattgggttttcacacatcacatgtttaccagcatgcaaccctggctacagtaa

SEQ ID NO: 3158 - DNA, 312 bp; double-stranded, linear
ccaggcagaggagcagcacaccaatacacaaccagctggacaagtgatcagctgatccgaataacgtgcacaagacaacctggaatcaagcaacaccggcaaccaagcaggtcaaggaataccaagcaacactaatataatgcacaccggcaaatcaacacagcagcgaatgtccagcagcagcgaaccagcagcactgtagcagcaacgacaactcagnccaatgtagcatatggtgaggcagtttatagacatacattgtgncctgcattcacagtggatagcaggtccactgtactgtacagtaagtan

SEQ ID NO: 3159 - DNA, 171 bp; double-stranded, linear
aatcacatcaaaaacttcaattgtttacgttggcaactaactttatgttagaacgcacacaatatctaatgtttaaaatctatcgtcgcaagatgcttcctgntaattatcagtgccattttcgattgggttatacaatctagtaatcgcatgataatttaatgctacaag

SEQ ID NO: 3160 - DNA, 211 bp; double-stranded, linear
cttgttcatttaatccatatagtatacgacgatgtactggttttaaaccgtcacgaacatctggcaatgcacgagcaacgataacactcatcgcataatctaaaaatgattcacgcatttcactggtaatatttcgttcattaatcntgattgagggaattccgcccatccagangtcccccctccaaagttcagttccacaggggctaga

SEQ ID NO: 3161 - DNA, 321 bp; double-stranded, linear
gcacaggtagcggtagtggcggtcgtatgatgactttggtaatctaaagcaaaatgtacgataataataaacgtcgtttcgtttctctgatgtagcaggggcagtgaagaaacaagattattgaattgttgatttcttgaagatataaaaattcaagaatgggtctaggattcctaaggtgtcttcttttgggctcagtacgtaaacatattgtagagcgtgcagtgagtggcgcaccatctcttttgggtcagntttggagttttgtttgtcggctgtcggattntcgtatgtaggaacggctgttcacttncgtggatg

SEQ ID NO: 3162 - DNA, 159 bp; double-stranded, linear
aacatttgagcaatatcaagaaacattagagtatattttatcccatcatgtaactcgtaatacagcaattattgctttgggtggtggtgcactggtgattttgctgggtttattgcggcgacacttttacgaggcgtgcactttatacaagtgccancg

SEQ ID NO: 3163 - DNA, 157 bp; double-stranded, linear
gtcagttatggcaagtgcatcaacattttcagacacagacaagtcttacggcatcttctatttttaagcttgaaatttaacaaatcataagccgtatgaatatttaaatatgccaccatgattgaatggcccctttctattagttangttttgtgcg

SEQ ID NO: 3164 - DNA, 216 bp; double-stranded, linear
tataaaaatataacgcggacaaaaaagtgagttattactgacaaagtatntgagattgtaacaggatatatgaagcaatatcagttgatccaactgtcataggtatttcatcagcaggngttgttgatgaacaaaaagcgaaattgtatagcaggccaacattccgattataaaggtataattttaaggattattaaaatcatgtctcttatgtca

SEQ ID NO: 3165 - DNA, 175 bp; double-stranded, linear
agaaacacttctattgaatcgtcttactgctgttctctatttataacacttcgtattgaatgaattcattatgcctatttgacacattattgaagttttcctaatgcctggatcctttatacgttacggcttcgtgctatgttttggtacataaagctttgacatatcganattc

SEQ ID NO: 3166 - DNA, 160 bp; double-stranded, linear
actgttacaacaaattaaaaatacaacaagcgagatatagttattgttgctggantgtaccaagtagtattccaagcgatgctatggcaaattgcacaaattacagcacagacaggtgctaaattagtagtcgacgctgaaaaagaattgggctgaaagt

SEQ ID NO: 3167 - DNA, 156 bp; double-stranded, linear
tgtgggggaaacctgcacagcaaaaactaaagcttatcgatacatctaaacattgtattataaaatcagtgcatcctagtccactgtctgcatatagaggattctttggatcaaaaccgtattccaaagcgaatgcctatttagcgtcagtaggna

SEQ ID NO: 3168 - DNA, 174 bp; double-stranded, linear
tattagtaaagtgatcaagaagaaatcacaaagatccagttaatganttaacagaattcggtggcgagaaataccgcaagcataaagatatctttgatccaacttaccaacagatcaacggaaaagtaccaggtaaccaggaatcaagatccagacacaggaaaagtgatcgag

SEQ ID NO: 3169 - DNA, 213 bp; double-stranded, linear
tcaaacggggtcaatttcaaatggaaaaattataccgcatcttctcctgataactacgtgaccttatcttctttatatttgcagaccacgaacattcaaactgcatgcttgctcgattggcaatgtcatataactagtaacatgatcatcncatcaaatttagtatgtcaaatgtcccaatcantaatttgatcggtgttgctcaattgatta

SEQ ID NO: 3170 - DNA, 380 bp; double-stranded, linear
aaagcaccttttcctaatgaaagttgtgctactggtatctgtgtttgatttacaaaatcttctaattcttgatggaggtgaaaactgttaatttcatgtccagtaatgatgataggctgcttcgcttgatgcagtttagttgctaataactctatatatgttgatgcatccgtatatttagttgccgtcacttcaaatggtgtcggtatctcaatttcagagattgcgacatcgattggtaaatgtaaatgaactgggcgtctttcggcgattgctgtattaattaaacgtggtatttcggttgttgcattttcaggtgtgatataacctgtgcacgnttatatgtgcaaacatttttcgatagtcgtcaaatgtaccnn

SEQ ID NO: 3171 - DNA, 401 bp; double-stranded, linear
tagaaggtaagaaggatcctatcggtgcaatgggatatgatgcgccaattgcagtgttgaacgagcgaccagaatcactatttaattactttaaacagctgtttgcacaagttacgaatccaccaattgatgcgtatcgtgaaaaaatcgtaacgwgtgaactttcttatttaggtggcgaaggtaacttactagcacctgacgaaacggttttagatcgtattcaattgaaaaggccggtattgaatgaatcacacttagcagcgattgatcaggaacatttttaaattaacttatttatcaacggtatatgaagggggatttgggaagatgcgttagaagcattaggccgagaagcagtggaatgctgttaagcaagggcgctccaaattcctagtggt

SEQ ID NO: 3172 - DNA, 166 bp; double-stranded, linear
acataatttaaaataatattacatttgtaatggncaccaagtaacgtttcggttgcttggtgttttttggtatgaattactttctgttacaaaacaatctaaagcgttctgttatgttttattaagatttaattacaaacggaaactaaatgtaatagaataaact

SEQ ID NO: 3173 - DNA, 160 bp; double-stranded, linear
ataatgagantgttgtacgttatggtggtggaagtgctgatggtgattcagcagtaaatccgaaagacccaactccagggaccgccggttgacccagaaccaagtccagacccagaaccagaaccaacgaccagataccagaaccaagtaccagacccag

SEQ ID NO: 3174 - DNA, 158 bp; double-stranded, linear
ctttatataaagaaggaattactaaacatacagttagattacttcatgcaatcgaattagaacgtttgaatttaagccgtagattaggttttgaattatcaacagcnaaagaatcacgtattgaacgggggttatttagaacgtgataaagaaggatg

SEQ ID NO: 3175 - DNA, 154 bp; double-stranded, linear
tatttgaagatggctgtgtacaaaaatcggtgttacgtgatcatgatactgtcagaatttataaaccatggctaacagcacatcagctttcattgcccnagtatgtcgtcagagaagatacacctaatcgctaattaatgaggtttggaaacat

SEQ ID NO: 3176 - DNA, 472 bp; double-stranded, linear
agaaggtattttagctcaatctccaggtctaaaggttgttattccttcagcccatacgntgcgaaaggtttattaatttcttctattagaagtaatgacccagtcgtatacttagagcatatgaaattgtatcgttcattccgtgaagaagtacctgaagaagaatatacaattgacattggtaaggctaatgtgaaaaaagaaggtaatgacatttcaatcatcacatacggtgcaatggttcaagaatcaatgaaagctgcagaagaacttgaaaaagatggttattctgttgaagtaattgacttacgtactgttcaaccaatcgatgttgacacaattgtagcttcagttgaaaaactggtcgtgcagttgtagtcaagaagcacacgtcaagctggtgttggtgcacagttgtagctgaattagtgacgtgcatcccttcattagaanncctatggaagagtgcaca

SEQ ID NO: 3177 - DNA, 150 bp; double-stranded, linear
tgaaagctggcgaatacagtgattgtcatgatgcggatctanttgtcatctgtgctggtgctgcacaaaaacctgagagaaacacgtttagatttagtatctaaaaacttgaaaatattcaaatcaattgttggtgaagtaatggcatca

SEQ ID NO: 3178 - DNA, 166 bp; double-stranded, linear
ttactctatcttgatttgacgaaatactattangctaatatcgatattttaaaaacgagatgatgttccaaagcaagccatttcgatggactgctaatattcttcagccaaacgtatcattttactcgcatttggtgaaaagaaacggctgctattacacatttat

SEQ ID NO: 3179 - DNA, 170 bp; double-stranded, linear
cttcgactctagaggatccccgcgctcaaattctagtgttagatgatagtggattagttgatagcaatggctttgcaatgccgatgttactcgcaataagtcatgtgcatcaattacttattaaagcagatttacgtatgtctacaagtttanttcgctaaatctggtga

SEQ ID NO: 3180 - DNA, 297 bp; double-stranded, linear
agctaaggttgccntgggcgttgccccanttggttagtccaggtggtcgcggtggccatcggtgtattcgccaggtccttcagccagggtttttactattatatccagttgtagcattcatgattggggcgattcgagatagattcatcaatgaaattaatttctggattttattcgttggtatttatttgggtatacataagtatggtacatgataggcagatatacaacattacaacattcattctactatgctggaaataacatgacagtgatgacactactatccccgtcgca

SEQ ID NO: 3181 - DNA, 349 bp; double-stranded, linear
cactaggtaccccaaaacgccagaggaacttggttaaatcgcacttacttggtggctccaatcaactggtacttcataacgtttggcatcttcgccacttcaccactattactctttccacctaattggttcatggcttgtgctaacgtttcatgtgcttccgctgaaatcgatccataactcatcgcccctgtattaaagcgtttgacaatgtcacttaccggttcaacttggtcgatgtcaatcggtgtacatgctttaaattcaagtaaatgtctaatgtgatctgttctatttttgttncaccgnttncagagtatgctttaaattgcgccatagtccattttct

SEQ ID NO: 3182 - DNA, 149 bp; double-stranded, linear
taccaacacgtacaccttctaaaataactgcatttgcaccgtnttaatacatcatcctcgtttataaccggtgtaagcactagggggttcaatcacacctgctaatactgcgccagccctacatgtacatttttaccagttgtagcacg

SEQ ID NO: 3183 - DNA, 147 bp; double-stranded, linear
gcggtgccggtgttgcaattggcgcagtggtgttggtagcatgtggtctttcaatcaatgttcaatacaccaggagatccggaaaagatgcgtatgaattttatggtaagtgcaccaggcattaccacaccacgcaanaacatgcat

SEQ ID NO: 3184 - DNA, 180 bp; double-stranded, linear
cagcgatatgttggcgttgaaaatctgcaatttgttcataattctctgttaaagaacgacttaaattgataaaaatggatacgatctcttggtaaacagtgacattttctcaatcggcgtatgatgtttgtggcaccgaccatcgagaacatgaaaatctcatgtcccacgctagtcgnc

SEQ ID NO: 3185 - DNA, 150 bp; double-stranded, linear
ggtaaatacgtattaatcagattaagatctggtgaagttcgtatgatcttatctacttggccgtgctacaatcgggncaagttggtaacctacaacacgggttagttaacgttggtaaagccggcacgttcaagatgggaaaggtatccg

SEQ ID NO: 3186 - DNA, 146 bp; double-stranded, linear
gaatttnaggtgaatcagaagattaacgctgttgcgtcctaagctaacagatactggttcgtcagttgtcgttgaaaaagcgaatgaacaatttaataaaaccgtaactcgagcattattagaggaagctaaccaaagcaggttta

SEQ ID NO: 3187 - DNA, 165 bp; double-stranded, linear
aaattggcgagtatgttgttattgggtcagtactctgaaattaacaatagntacgattgaaaatggtgtcatgtattcaacagtctgttgttaatgtatgctagtcgtggtgcgaatactaaggtcggaccgtttgcgcaattgagaccaggcgcgcaattaggg

SEQ ID NO: 3188 - DNA, 166 bp; double-stranded, linear
cagtttagtggagacgaatctaaacgaaacaaagcgattggacgtgcatcagttgtaccaacattctttggtgtaaacgnaaccaattttatttggtgccaccactagttattggaatcctgtgttctttattccatttgtattagcaccaattgttaacgtatgg

SEQ ID NO: 3189 - DNA, 146 bp; double-stranded, linear
aaccctttatctaatccattttcagttaagcgatgaccgcctgctaaaatttgtgcatctgattcttttgctgcatcaatatatgattgaattttatctaattgatccttaccagtttgactacccatttgggtngcttcacctgg

SEQ ID NO: 3190 - DNA, 212 bp; double-stranded, linear
tcccccaaagggtttaaggggttaacccgggtttgggaaaaattttttaaccccccttaaanttcccgggaaaaaggaaacccgggtttttaaaaaaaacccggggttcccaaaaattttttgggaaagggaaaggaaaaaagggttaaaaaatttttgggaaaaacccgggcccanaaaaaagggtttttttccccttaaaaaaaatttaa

SEQ ID NO: 3191 - DNA, 148 bp; double-stranded, linear
cttcactgactttagcaatttcatcaccttttgcccctacaacgatagctaatgatttatattgtaaactcanatgaccttgttgaataccttctgacacaagcgcgcgacatgctgcaaagttttgcgctaaaccaacggcagcaac

SEQ ID NO: 3192 - DNA, 212 bp; double-stranded, linear
ctgctaatccgaaatctttttggagttttattaaaccagctgcttctaatagtttaagtgcacgtgcttggtttgacacatcatttggaatgacaactttagcnccatctttaacctttttgacatctttaattttatctgcagaaataaatccatcacggatggctcttaaatatatgttacgtgataatttctcganaaatggcttccct

SEQ ID NO: 3193 - DNA, 141 bp; double-stranded, linear
tcgtgcagtggtcttctgttaattggtgaatttggatactggttatattcagctgcaccgcaagcaacttctattgatggccnaactgcctttttacctcaagcaatgggtatggtagttgttgcagtcatttatggcttt

SEQ ID NO: 3194 - DNA, 1290 bp; double-stranded, linear
aataacgttctgaaaaacgaagatgttttaaatgcctatatccgcggtcgtggcggaatggcagacgcgctaggttgagggcctagtgggagaaatcccgtggaggttcaagtcctctcggccgcatcaaaattcttaatttaaataagcgggtgtagtttaatggcaaaacctcagccttccaagctgatgttgtgggttcgattcccatcacccgctccatagataattttaatgaacattgaaaactgaatgacaatatgtcaacgttaattccaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaatacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctggcataacgcattaagcactccgcctggggagtacgaccgcaaggttgaaactcaaaggaattgacggggacccgcacaagcggtg

SEQ ID NO: 3195 - DNA, 140 bp; double-stranded, linear
tggtacagagttatcgctggtggtcctgttcgtgccgtacttgaattatcaggtatcactgatatcttaagtaaatcattaggatcaaacacaccaatcaacatggttcgtgctaacaatcgatggtttacnaaacctta

SEQ ID NO: 3196 - DNA, 145 bp; double-stranded, linear
ctattggatcaggaggcaactacgcttaagcgcagactgcccattgaaacgccatgcatcgcatttgtcgcctgaagaaatggcatatgagagcttgaaagtagcggctgatatttgtgtctttaccaacgntaatattgttgtc

SEQ ID NO: 3197 - DNA, 310 bp; double-stranded, linear
tgtcgagttggaattggacgattgaatatcccatctccatcactatcaaagtatgggaattgaattgtttctaattcgtatccaccttctgtcattgataatgtagggttaattttagaaccatctkctgtttctagttttaagttccacttcttaccttcttcccaacgttgacccattgtgccattaggtactactaaactatcgctgattgcatcatgaataactggcttccattcnccttgctctgttgtttgacctaagtcactcgcgctnaaaaatcgacccgctttatatccatnttcagctg

SEQ ID NO: 3198 - DNA, 140 bp; double-stranded, linear
tgctttattaatgcattggctaataatccacttgtaccaccaccggcacaaagtactaagaggtttgttctgtgatatttgaagctttagtgcatcgtctgatacaccacttgccgctaaaattgaatcagcttttntcg

SEQ ID NO: 3199 - DNA, 184 bp; double-stranded, linear
tggtgatttcaaatcatgagactgggacaaaatgatgttttcataaaaattatttcgttgttccactctcatgatttttttgatgaacataattacatgattgattgcatcatttgttaaaaccagtgattgcaacctgccattcacanggaaaattacctaataagtggcgtatttaccagtc

SEQ ID NO: 3200 - DNA, 163 bp; double-stranded, linear
ttgagaagcgtttaggaagtaacgtttaacgacgacagtcgttcaatgcgatcaaaatgttttaacacatgaatcgctctcgtactattcgtgtgtgacacatgttcttccagcatttgcttaatgaatgctttttcttcttggtntttaatctttgtaaacg

SEQ ID NO: 3201 - DNA, 149 bp; double-stranded, linear
gttatgtttgagactataatgaataaatatttagaaatatgactccgattgttcgatgcttaattcagttagaagcatcataagaatgcatgattactggtgtaaagatacgtaatgtnttgtattgactggatgtctttggatagagt

SEQ ID NO: 3202 - DNA, 192 bp; double-stranded, linear
caagtgactgagattactgaagtaaacccgttaccgccacactatatttgtccgaactgtaaaacgagtgaatttttcaatgatggttcagtaggatcagattgatttacctgataaacgtgtgaanttgtggaggccactattaaagaagacagaatccgttgaacatttagataagggaaagtccgattc

SEQ ID NO: 3203 - DNA, 234 bp; double-stranded, linear
ttgcaagagttgtgaagatagcggttgattttgctttataatatcagccngctgactttacgccatctaacgttttttgtattcgttgttgctgagctagttgtaagtgccncattaagcatcttatagcgtgatagccatgcgccaacgtacaaatctgctccgtattgtacgcaccactaagcagtacacaccagtaacatttgatagcgttatagcgcaatatacagtaca

SEQ ID NO: 3204 - DNA, 178 bp; double-stranded, linear
aacgccataagctacatgtatgcttcttgcatggttatcatcctctcttaatgactatcttttaattacgnaatggcttaccagtttttaacatatgtgcaattctttcatatgatttttagatttagtagcataagcaatttctccacgttgatgtacgtgatgtaatgattctggg

SEQ ID NO: 3205 - DNA, 147 bp; double-stranded, linear
tattaatcacgttgttgtgcgttcgtgttttcgcagtattgatttgttgttgcgcattatgcattgcattattgtactgcgtaattgtacctggctttttaccttcagtgcttactggntcatctaaatgatttttagctgtgatta

SEQ ID NO: 3206 - DNA, 133 bp; double-stranded, linear
cagctgtactagttgagcgtattatccaaaacattttacgtgatggcattgatgtcgatcgactttcagtcgtaacgtttacaaacttaagcgcacgtcanatgaagcatcgtgtagaccaacgtattcaaga

SEQ ID NO: 3207 - DNA, 145 bp; double-stranded, linear
tagggactttgaagcggagagtctaatgcatatgggcagcattatgatcagcaactgctgagaaaaatccagttctagcttgggatttaaatgtggagtggnttaatgaatgcattaagaagctgcaagaacttataagtgtgca

SEQ ID NO: 3208 - DNA, 131 bp; double-stranded, linear
aaacggttttagatcgtattcaattgaaaaggaccggtattgaatgnaatcacacttagcagcgattgatcagaacattttaaattaacttatttatcaacggtatatgaaggggatttggaagatgcgtt

SEQ ID NO: 3209 - DNA, 157 bp; double-stranded, linear
ataaatttatctataatctgttgcttgttttnctgttctacaagtattttcacattaggtcccgcatccattgtaaaataacacggataccccgcttctcggcattcgtgaacagcgccatgacatcataactttctgcacagtaggaacgggggtg

SEQ ID NO: 3210 - DNA, 143 bp; double-stranded, linear
aacgtaatagatatggtacttactacatgggagagagtgctagattcacaaacggcaatcaaccaatcacagtaagagaagtggggccattcttatctngtccagtgggttatcagttccaacctggtgggtattgtgattat

SEQ ID NO: 3211 - DNA, 137 bp; double-stranded, linear
atgcatactgtatgtgttccagcatatacaattttgnccatctttaatgacaactgtaccatttttcacaacatttaattcatctaattccttacccttcaaagtttatctgttgatctcggtaaaattaattctgc

SEQ ID NO: 3212 - DNA, 239 bp; double-stranded, linear
attcacgctttaaaggacgtaaatacacgactaggctgtttacctttagatctaaatcagaacaatttttttaccatggtgttccccttgaattaggaattttatataaaaataagcgggaagcgttgtgccccgcttactcataagctttaattaatgctaaatagtctgacactagcgatttgataaaactatactaaaattatttagaagtcactaagatgctaatgacgacnant

SEQ ID NO: 3213 - DNA, 150 bp; double-stranded, linear
catcctcagagtaggaatagccataccatcgaataattcacgtactgtttcgaattgaggttcaaattcttgagttgtatagagctcgaaaatntttgcccattagcataatcagacttttcaaaagtcttgatatttgatacccacgct

SEQ ID NO: 3214 - DNA, 399 bp; double-stranded, linear
ctaagcattggtttaaactaatgttcagagctttntgtggtttgtaaanacaagtatattncgagaacacgtttttgtatagagtctcaattataaaagttagaatagttgacaacagtgttacgatattattaaacaactgtctatcattaacgaaagcaattaacaagagtacttgttgtgaaatcatcgtttaatagtcaaagatgatcatcgtagggtagacaacatatcattgacttaaggaaggggaatgaccgatgggattaaaagatcaagctgttacctggagaaggtattttcatcaatttccagaactatccgataaagaatttaagactacacaaaaaattaaagatattttaacagaacatcatattagaatattagacttaccac

SEQ ID NO: 3215 - DNA, 386 bp; double-stranded, linear
caggtgaaagcacaagaggatttgctgtttatttctctcctgaaattaagaaattcattgcagataatttagataaataattaaaacttagacattcacccaatcctgacaaaatatactataactaacatttattaatatatattgcattatttaatatgcatcaaagccaatcaacgrttgattttcaccaactcaattgttgattggttttatttatgtatgaatgaacaactttttgacatcattaagaatataaatgcgtttgaaagcatttgaaagcnacaacatttctataaaatttttcaataacaattgcgccactaaaactcaaaatttccaccaccaacatccaaattatcaacatcgcaacataaccaaatggt

SEQ ID NO: 3216 - DNA, 153 bp; double-stranded, linear
agttgcatcaactgaatccaacgctacgcaatacgaattattccaatctggcatgcgtgttggtagagaaattttagcgacatctcgagcacggtttaccttgcctttnttggtggccaacttgctttatgctatgggtttttcaaacttaaa

SEQ ID NO: 3217 - DNA, 138 bp; double-stranded, linear
ctttgcatattctggtttgtagtattcatggtccgtcaattgtagacccatcaattgcagccattacatatgcggaatatcgaagcgaacttcaagttgcttcaagctggtagaacacgcanataaaattattacatc

SEQ ID NO: 3218 - DNA, 487 bp; double-stranded, linear
cactccaaaccaaggatttacgtgctttatatngaggtaaagcacatcatgtkgttaattttatgcmttttattgcmcmagrattaagagaaattttagcntctttaggtttgaaacgtgtagaagacttagttggaagaactgatttattacaacgatcatcaacattaaaagcgaatagcaaagcggctagtattgatgttgaaaaactgttatgtcctttcgatgggccaaacacaaaagaaattcaacaaaatcataatcttgagcatggatttgatttaacaaatttatatgaagtaacgaagccatatattgctgaagggcgtcgctatacaggtagctttacagtaaataatgaacaacgtgatgtaggggttattacaggtagtgagatttcgaaacaatatggagaagcaggacttcctgaaaatacaattaatgtttatacgaatggtcatgctggtcaaagtttgcagcatatgca

SEQ ID NO: 3219 - DNA, 176 bp; double-stranded, linear
accaactcggaatcatgcaatgaacaccatggttgaaataagtgaattgcataagtatcctggcctggcaatgctggtataacctaaaaccttgttgcacgnaatgtattcgctacaattaatgtacctgcaaaaccgtttaataagaagttcgaaatcgttgcacctgtatatgg

SEQ ID NO: 3220 - DNA, 203 bp; double-stranded, linear
ctgatttaggtaatctttgcgcaattgtttttttacagtttcggcaaatgggtgcccnggcaaataaatattggctatgctcaaacctgaattaatggtgggtgtgtccgccatcgtaattgggnccgcctgaagggccgcatataaatgatagtgctcttccgaataaaaggtaggccatatgtaattgttttgtggttacg

SEQ ID NO: 3221 - DNA, 361 bp; double-stranded, linear
agctaaatcttgccaatatggtatcaacttttcattccactgataatcataaatttcagagtaggctgttggccaaggtgtacaggccaattaggctttttagcggtatcatctgatcctgcaatgccagaaatgtattaacaactggcacgtctaatagattgctaacggattgtttacgtacgttcatcggcttctttcgcttctatcggatctggagaattgggatgttatgaccactgaaccacttatttgtaagctctgtcgtgattgacttcataatgcttgcgcttgncctcatttctaacaactcatcctacttacnaaattaccccnggggtacacctggtccacttcatca

SEQ ID NO: 3222 - DNA, 152 bp; double-stranded, linear
ggggctccgnggaggcaagggtagaaaatgatgtaaacgctgcattactaggcgaattgaaattacatcaatatcaagcagaacggatcttttgtatgacgcttggtacaggcattgggggtgcgtacaagaattaatcaaggttcatgttg

SEQ ID NO: 3223 - DNA, 123 bp; double-stranded, linear
tttgttaaatataggccctgcaatgagtgtactggaatggcaataatcataccatacagtaatacatctccaacatttgccttnaattcttttcccatgactaccggtcctgggatgtggtgg

SEQ ID NO: 3224 - DNA, 145 bp; double-stranded, linear
gagacaacaactttaaagcgtaccggcctggtattgaagcacgattgatctcaccatatatggttggtaaccgtaaattaatgcctgacaatgatattagctncctaagcatatttctgatgatttaacacattatgaaacgaga

SEQ ID NO: 3225 - DNA, 129 bp; double-stranded, linear
ggtattgtctagtcaattactaacaccatttaattgtggnaagcaaaagctaaaggttatcgtgcgctattgcaggcattgatgcttccaacaaagtcgagtattcagttgcatcaaaagtttgctttt

SEQ ID NO: 3226 - DNA, 170 bp; double-stranded, linear
gacactaccgttcccacgtagcatcaatcgtctcagtcgcatcgtagtcatctgtatgtgttccagcatatacaattttgccatctttaatgacaacgtaccattttcacaacatttattcatctantcctaccctcaaagttatcgttgatctcgtaaatagtcggcaa

SEQ ID NO: 3227 - DNA, 140 bp; double-stranded, linear
ttactgctttacgtttatcattttctaattcanaaattcgtcattcagtttcaactttatcgacagctggactttgcgcagataaatgtgctgctgtaatatctaacacatcgattgctcttatctggcaataatcgttg

SEQ ID NO: 3228 - DNA, 120 bp; double-stranded, linear
gcgcctataattgcgctacttgatttaattgagtagataaatctaatccgaataaatccgtgacttgcttgataaatagcaacaatgctncaactaaaccagttagtactgctttgtttt

SEQ ID NO: 3229 - DNA, 119 bp; double-stranded, linear
ggctatacaccgactacagtaacatctggtagcgacattgaaaaagactctaatggtttaacaacaacaggtgttattaatggtgctgataacatgtacattagatagtggnttctaca

SEQ ID NO: 3230 - DNA, 128 bp; double-stranded, linear
tgggaatagcaaccaacaatgcgacaacaaagcccgctacaaatctccatnaactaattgctaaatgttggaaaaatttctccagtcaacaatgaaaggccatatgactttttcctacaagagcaggg

SEQ ID NO: 3231 - DNA, 123 bp; double-stranded, linear
aatgcagctattacttttcacagattccatatcgttcaacatttaaatagagaacttaataagtatcgtgtacaagttatgaatgantaccgtaataaaaaaggacctgattatacaattttc

SEQ ID NO: 3232 - DNA, 1656 bp; double-stranded, linear
gcctcaaagaacatgctgaacagtcatcgcattcatatagtttgaagtctcgtttaaaaccatatctatcattacggtatgcatatcttttaaaacctattcttttgttattaggacatataaattcatcattaagttcgtcatatttccaattttgagtgtcgaaaatgtcacttttaaactttctagttttatctttaataaacatgccatacgtaataagtggcgttttattaaaatcatctataatggccatatagttttgctcactaccataacctgcatcagctacaaataaccgaagtattttgaatcattgttaaaaatggaattaaagttctagtatctgtcgggttttgaaataggtcataggataaaacaaattgagaatttgtcgctatttgtaaattgtatcctggcttaagttggccatttttcatatggtcttccttcattctcataaaagttgcatcatgatcagttttagaaaarctatttctatctttaagaatcgatttttgttcttcatatttattttttctttcggaataatcatcaaatttmtttttgaacttcttaatcttagttcttttttacgggtctgttttctaatttgagtactatcttcgttctcaatagaatgatttaaaycttcgatttctttatctaaatgactaccaattaaatctatttcttctattgttaaatcgctatctccatcttcttttatctctggtattattttttcttcaactaagtcacgatataatgtttttgaattttcgttcaatttcgattcgtgattttgaatacttttcttccacacaaatgtatacctattggcattagcttctacttttgtaccatcaataagattttgctttaaacattgactatgaaactggataaataaagattcaattaacgcatcagtattaggattcactctaatacgattaatagttttataagaaggtgtttgattttgagctaaccacatcattcgaatactgtcatgaagtaatttctctattctacgaccagaaaatacagattgagtatatgcatataaggtgatttttaacatcatttttggatgataggatgttgcgccacgatgatgtctgaatttatcgaattcgctatcaggtatcgtttcaacaatttcattaacatatcgcgaaatatcaatttgaggaattctaacagaagtttctattggtagtgtaagttggatcaagttataatttttatacataaggcacttcattaatttagtttagtggtatttattaaattatacgaagggacccaacacagaaaattcaaattattgaattaaacatttatgtgcaagtttggcaaagtgtcttattttttaaaagtatgtaaaagtaaaattacatgttaatacgtagtattaatggcgagactcctgagggagcagtgccagtcgaagccgaggctgagacggcaccctaggaaagcgarccattcaatacgaagtattgtataaatagagaacagcagtaagatattttctaattgaaaattatcttactgctgtttttttagggatttatgtcccagcctgttttttgtgatttttaataatttgaatatggraaatgtattawtctctcatttgtatagatt

SEQ ID NO: 3233 - DNA, 130 bp; double-stranded, linear
ttgctcataaatcttttcttggcgctctgaacactatcttctattctgtcggaatttttcaaacatagtcttatcatttncttctaatcgcgttaaacgccaatcttgttcatgtcgtttggtaaatcca

SEQ ID NO: 3234 - DNA, 122 bp; double-stranded, linear
gccacgataaagaagtaagaacaacacatggtgttactggtacaggctcatgttcttgggaaagttatttgtgnaaaatggtgtgaattacctggggaaaaatcaacaaactgactatccaa

SEQ ID NO: 3235 - DNA, 173 bp; double-stranded, linear
aaccaggatatgaaatctgtgacttattgcgttagatcgttttgtaactgctactattgaagaagcagaccaatataaaggtaccattcattgcaaaagcattacatgcatgaacccagttgacatttagttagagatggaagatagtattgtgcatttgcagnttccacatg

SEQ ID NO: 3236 - DNA, 122 bp; double-stranded, linear
gcggtgtgcatttgaaaatgttatcaagaatattgagttaattcgcaacgacattataccagcgattanaaagcatttatcaaaatacgaggggcgtcatcatgaatattgtattattgtca

SEQ ID NO: 3237 - DNA, 182 bp; double-stranded, linear
ttttttgcccaaaatttttgggttttttttgggttaaaggaaaaaaaatttttaaaggggggggggggtcccccaaaaatttttttcccttccctttggtttggttttttggggggggggccccccccctttggaaaaccccttaaaaaaatttaanggttaaattggaaaaaaaaatttaa

SEQ ID NO: 3238 - DNA, 111 bp; double-stranded, linear
cagtgcagcgtgttgatagcgcgacatgagattttacgaacacaatatattgttgtagatgatgangttcgacaacgtattgtggcagatgttgcagttgactttgaagaa

SEQ ID NO: 3239 - DNA, 120 bp; double-stranded, linear
agttgatcgtattttccagaagagacagaattaattgattatcgtgttagttctgtcactgaaggtactgatgcccaagcagnagtacatgtaagtttattgattgaggtaagactgtca

SEQ ID NO: 3240 - DNA, 127 bp; double-stranded, linear
tacacatctntctacgattgtagtttatcgataggtttcgcatcatgaaacgtgataaacaaccaacatgatgctagtttgattaagtttcttctaaacagacttcaaacggcagtgtttagcatat

SEQ ID NO: 3241 - DNA, 124 bp; double-stranded, linear
gactaaaatacatgttggaatacttggtcccatgggaaaatattggactgggtaacccaatcacggcttctgaagtagttctttntcttctattaaaatagcgacggaatcacaccttctgcgg

SEQ ID NO: 3242 - DNA, 122 bp; double-stranded, linear
tacgtgtatacaccgttatctttatggctttgaatttccataataaatacatacggnttttgtgcagagctcagcacataatcatctttaactatagtttctgggaatcacttcatagtttt

SEQ ID NO: 3243 - DNA, 221 bp; double-stranded, linear
aaccttttctgcaaccatacgccataggtatgttttctttttacaattaaagagccaaccgttgttatagtctaacaatggttggctcctcttattttatgtgctaaaaatttataggcaattttattacaacaatgtacatttaaggtgaccttcatgccaaaatcgcatcactcatttaatggaagcagcacgtcttcatacaaagtcacgatcctaat

SEQ ID NO: 3244 - DNA, 224 bp; double-stranded, linear
ttgcattttgattgtctggtgaccttggcaatgacaattcccgcttgcaatcggtatcttcaatattataatcaggtcttgccttagattttcgctaagtaccggtgattctctaccatcatactcacctcatgngctatttttctagagtgcttcttttcacactttatcttataaaaggctagctactattaccgatttatcattattagtggtttttaccn

SEQ ID NO: 3245 - DNA, 117 bp; double-stranded, linear
gaaagagattagtgacaagttggttgtactattacgttaaaatttggagattatgtgtggtgttcaagtatgcgttcantaattgatattggcgcaccgtataaccatgtcaaagta

SEQ ID NO: 3246 - DNA, 117 bp; double-stranded, linear
ctacaggctttcgtaccacaggatcaaaactacgcactgtgccttgtacatacgcatgatcagcaatgacattccaagtattaccacatgatatttgnccaattgttactaccgttc

SEQ ID NO: 3247 - DNA, 117 bp; double-stranded, linear
tacacanctttctacgtgtgtagtttatcgataggtttcgcatcatgaaaagtgataaacagccaacatgatgctagtttgattaagtttcttctaaacagacttcaaacggcatgt

SEQ ID NO: 3248 - DNA, 135 bp; double-stranded, linear
cccgtcctttggtggaaccgttttgtagaattaaataatattacagagccgctagcagtaacgatccaaacgaatttaccaccatcacgtggattaggatcgagtgcactgtcgcggttgcntttggtcctgcca

SEQ ID NO: 3249 - DNA, 106 bp; double-stranded, linear
aaaagccaacccatgnaatgttggattggctttttacatgccatctgaatctctaattttaaaaaaatatggaatataaataagacagtaaaaattaaatttcagt

SEQ ID NO: 3250 - DNA, 122 bp; double-stranded, linear
aacgctgaagcagataaaaaacgtcgtgatagaagtagacttaagaaacgagtctgacantctagtattccaagttgaaaaaacttttaactgtatttaggcgaaaatatcggtgaagaaga

SEQ ID NO: 3251 - DNA, 132 bp; double-stranded, linear
gaacgttgagatgtcacaaactggtgaaagtgcacgttcaatgccaatgactgataaaaccaaattcatcaatcacaattactccgaaagcnggtacaggtcactcagtaagtagtaatcccagtacattaa

SEQ ID NO: 3252 - DNA, 115 bp; double-stranded, linear
ggaaaatcttcaaattctgcaaattgccaatttacctaataaccaaacatctaaggcatgtgtaatgctgctacntccgcttcgtcatcagctacaatgacaaatacaggtgcca

SEQ ID NO: 3253 - DNA, 140 bp; double-stranded, linear
tttcgtcaaattatgggaataaaataatcatatttaagatagtaaatattgaataagttgctttgaaatttataaaatgaaagtatagtgtcatgggnagtataatagtcagatatatatgtaacggcactatattgaaa

SEQ ID NO: 3254 - DNA, 399 bp; double-stranded, linear
aaatctcctactttttctacccataaataattggctaactttttcatcttatcttcatcctttctcttctatttaaaatgctacaaataaatttccgcgagtaattttaatgttttacaacgctgttcaatacctggaataagcggtgctactaacacctcatcaacttcaracgtagcaatgaaatcatctaattgtgctttaacctwttcttgtgtacctgcaatgatgcgtgcttggatgtgcttgaatcatctctttgtctcgatcattaagcttatacttttgtgctgtgtctactgaaggaaaatcttcaaattctgcaaatgtaatttaccnaataaccaaacatctaaggcagttgtaagcggcnacttccgcttcgttatcagcnacaag

SEQ ID NO: 3255 - DNA, 116 bp; double-stranded, linear
accattcgtcaaaatattccaacacgcatttaggtgtgcaaggtatcggtacctaacaacgaagctatcgtctcactanccttaaaagattttagaacaacagctgcactcatcat

SEQ ID NO: 3256 - DNA, 106 bp; double-stranded, linear
aaagacctaaggttatgtaattggcctaaatttattaatcgtttaanttcagttagtaaaaagtctgtgagtaagggtgtatggaaactggttaaatattatagag

SEQ ID NO: 3257 - DNA, 114 bp; double-stranded, linear
aacgtccatcgtaataccttttgtgtctaatgtaacttgtacatcgtctaataataagttgacgatatcttgacaatgcatctttatctagatgtaaganttcaacggatgccg

SEQ ID NO: 3258 - DNA, 117 bp; double-stranded, linear
ttaaagcagttaatccacagggaaagtggttaatacagttgggctctggtggatagtacagttgcaggcatggtgggctgggaattgcttcagggtttaacgantgggaaaagcctt

SEQ ID NO: 3259 - DNA, 124 bp; double-stranded, linear
ggaccgccatatcgttggcaatcatcgcacctataatcatcgcaagtataataatattagcaccttgcatactttttaaccaggttgttaatgcctcaaaaatattagaaattggtgcccgntt

SEQ ID NO: 3260 - DNA, 130 bp; double-stranded, linear
taccaatgtatatccatatacttttatcataatcatttcagccgactttagtttgatgtttttgcttgattaaaatctttcggcgatcttcagcttgatgttttcgtttgattaaattggtacaatanat

SEQ ID NO: 3261 - DNA, 400 bp; double-stranded, linear
ggcctttttgggccggggttggaaattggggttgccttaattttttaattaaattttggaattaaaaaaggaaaaantccaaaggttaattttaaaaaaagcccaaggttttaaaaattcccccaaccaaaaagggggggaaaaaaggttgggggttttaaaaattanccaaggtttttggggccctcccttgggggttgggaattaaaggttaaccaaggtttttggccaaggggcccaattgggggttggggccctgggggaaaatttttgccctttcccaaggggttttttaaaacccggatttttggaaaaaaaaaagcccattttccccccaacccnaaagcccagttcccgcccattttcccggggtaaccctgcccccaccggggccattttt

SEQ ID NO: 3262 - DNA, 134 bp; double-stranded, linear
tggttcaatggaaacgtgtaccgcaaatnccgttaaatgttgttggatgttgagagacgtggctgaactggcacatttgggcaatgaccaatggaacaagctaatgggcaagcgattattgcgacggctgatgg

SEQ ID NO: 3263 - DNA, 105 bp; double-stranded, linear
tttttttctgttggtacttgttttgtggttggcgattgtggtgtgtctganttagtagattgcattggttgtggcgtgtttgcttgatggaggtgttgtcacttt

SEQ ID NO: 3264 - DNA, 107 bp; double-stranded, linear
gttccatcattcccaccnatatccaacatgtgggctactgcaatgctttaggcgtcaatgcctcatcatcatcacagcgccagtaaatgcgtataattaaattaatt

SEQ ID NO: 3265 - DNA, 109 bp; double-stranded, linear
tacaatgtttaataaaattgtttctattaattggcggcttgcaatcaatggtgcttctacgtcgtaacaatggttcgttaccaaagcatanttcgccttcttggcatcg

SEQ ID NO: 3266 - DNA, 104 bp; double-stranded, linear
ttacctttaaaataangttctccactagttgggctaaacaaattacatattttgcttttggaaatgtactttttaccactacctgatggacctataatgggcaa

SEQ ID NO: 3267 - DNA, 117 bp; double-stranded, linear
taagccatcagaaacaaatgcatataacgnaacaacacatgcaaatggttcaagtatcatacggtgctcgtccgacatacaagaagccaagcgagaacgaatgcatacaatgtaaca

SEQ ID NO: 3268 - DNA, 101 bp; double-stranded, linear
gctgcacaagcacaacctggaatcagcaacaccggcaaaccancaggtcaaggaataaccaagcagcacctcataataatgcaacaccggcaatcaaacac

SEQ ID NO: 3269 - DNA, 207 bp; double-stranded, linear
cataccctattttagatattaccttattacaaaatatttttacattaatgtcagctgcaggttagtattgttttccaaaatttaccggtcatctttgccaattgggtgtcgccaatcgggatttatcctaggaagccgattaaaagggtactgccagggttttagcctgcngctgcctcggggttttctttaaattaatgnaaccgc

SEQ ID NO: 3270 - DNA, 107 bp; double-stranded, linear
atattcgcaccaccataaacatagatggtgttttgtccttctgcattcacagtgataaaagggcttggncccgtttttgcttcagctgttttgaataatatatgatg

SEQ ID NO: 3271 - DNA, 122 bp; double-stranded, linear
ttggttacacttctgctagttttagtaacgatggtccaagattgtatgagcctattcatggatcagcaccagatattgcaggtaaaaacgttgccaatccatttgggatggttctnatgctt

SEQ ID NO: 3272 - DNA, 360 bp; double-stranded, linear
gaaggatgatgattcggagcancttcttgcagaagangcggnaataacgtgacatattgtattcagttttgaatgtttatttaacattcaaatattttttggttaaagtgatattgcttatgcgagcgcttgacaatctattctttttaaagaaagcggttgttagacaatgcattaagagaaattaaagcggmgtttacttttgtaaatgagcatttgattttttgaaaataaagcagtatgcaggcgcttgactaaaaagaaattgtacattgacaactagataagtaaagtgaaaatatagattttacccaagcaaaaccgagtgaataaagagttttaaataagcttggattcata

SEQ ID NO: 3273 - DNA, 112 bp; double-stranded, linear
tcaattttaactgcaaataataaagctgcatgatttactttgtacattattgtaatttcagtaatacgaggcaatgtcagtngcagtgtttaataaattttgttcgctattt

SEQ ID NO: 3274 - DNA, 336 bp; double-stranded, linear
tacatttatgcaatcaacgttacattcaatcgttggagaaaattggctttattgacttactaaaatctaaaaaatcatatgaaagaattgcacatatgttaaaaactggtaagccattacgtaattaaaagatagtcattaagagaggatgataaccatgcaagaaagcatacattgtagcttatgggcgttcagcgcagcgaaagcaaagcaaggcgcattattccacgaaaagacctgntgatgtcgcagccaaagtaattacaaggcgtatttgaaaacgtattgacggganaaattccaataaggattatggattgnaagatggtccatttg

SEQ ID NO: 3275 - DNA, 138 bp; double-stranded, linear
caaatgcttttgccaccccagatgcaatggtaccaacacctgttttcgaaactaattttaccggcgatatctggcatcttttatttcggcattttttcaaatcatggttattccagtttggcggcttaaaaattcntt

SEQ ID NO: 3276 - DNA, 101 bp; double-stranded, linear
cattatacgagnataagtaaaattgatgatgtgactaaaaaagatgcacaacaattattgaagatgcaaaagaattgcatgccaagctgatacattagata

SEQ ID NO: 3277 - DNA, 124 bp; double-stranded, linear
tggttattcgttcctgatcgttgttggtatctcactattcaanatttatcgtgtggcattactttagttacaccaggtacatttgaacctggcacttgttgcgagtatttccggtctcgtcatt

SEQ ID NO: 3278 - DNA, 110 bp; double-stranded, linear
gactttttgaccagttgtagcacgaccaccgagagtagcattgcatatgcaatcattgtaccttcgccaacgactgngccaatattaattgttgcgcccatcataacgac

SEQ ID NO: 3279 - DNA, 113 bp; double-stranded, linear
ttggtatatagagggcaaccgcacctgataaaatgtgncacagtttttacaagaggttaaggaatgagtttggaggcatacgagcatcaagataccattcgatgttagtaatt

SEQ ID NO: 3280 - DNA, 101 bp; double-stranded, linear
ttaccgtcaccgtaatcagtccatactttatcagctataccggctttaacagcataaatgttcgttcctgtaggcataccaaagncgataccatagtgacg

SEQ ID NO: 3281 - DNA, 116 bp; double-stranded, linear
actatgtttganaaattcgacagaatcagaagcacagtctgagaacgcaagaaaaaatttatgacaagttagatagaaatttcgacgaactaagggcgtgaccaagaagaagatga

SEQ ID NO: 3282 - DNA, 148 bp; double-stranded, linear
acttggttagataatatagcgtcgattgtatcacgagtgtctgttccagtcattataaaagaagatggtacactagcatcaacaaatgaagtaatgatgatgggaattaatcagcacacacgtcgttctgatgcttttcctgaatcat

SEQ ID NO: 3283 - DNA, 100 bp; double-stranded, linear
aaatgacgatagagtcaggtattaactcattttncaatagtatcaggaagactaccaagcttatgttgaagggcatcttttggcgttaccgggttgggca

SEQ ID NO: 3284 - DNA, 101 bp; double-stranded, linear
ttaagaaaccgagcagcgcataancctgcagtaccttatcgcttctagataatccgattgcgacaccattgcaagatgaccggtaattttggaacatatac

SEQ ID NO: 3285 - DNA, 106 bp; double-stranded, linear
taaaatatttcgcatccctacacgctaaaataatacattacacttaaaacggctgttttaaagcatcctcccataaacatcatctagttgataatagggggggggn

SEQ ID NO: 3286 - DNA, 95 bp; double-stranded, linear
tttaacaatacctcagaacatactatggaaattgctgcaaagttaattgggcatgcatattgatcataatgcgcttttaaataaaatggtggaga

SEQ ID NO: 3287 - DNA, 141 bp; double-stranded, linear
tcgaaataatatctacgcacactgataacataaaaatgcctggtagaatactaatgaaataagtgcatacatgaccacatgaatgctaataacatgcnagaacccattttttgaatatttcaccactcgaatcatcaatac

SEQ ID NO: 3288 - DNA, 107 bp; double-stranded, linear
tagctggaccagaacacggttcgacgttgcaggaagtcttgaacagtcgctgaacgccaaggcgatacttgggttatccatggtgaaagnaatggattggtggtgca

SEQ ID NO: 3289 - DNA, 89 bp; double-stranded, linear
gctttgcaatgccgatgttactcgcaataatcatgtcgcatcaattacttatggaaagcagatttacgtatgtctacaagtttaggcgc

SEQ ID NO: 3290 - DNA, 108 bp; double-stranded, linear
tgttacgccaacaacaaatcctacgtcgacaactatttttaagcgatgattgcaattagacagaaatccaatcatttttgcattccatccagtgcacagaatntcgag

SEQ ID NO: 3291 - DNA, 109 bp; double-stranded, linear
gatcaagncctgagaatttaatttaatttatttttatattggagatggttaaaatgctaaaactcaacatgagtaaccaaaatattgcccttaaaaatgctgatcattg

SEQ ID NO: 3292 - DNA, 121 bp; double-stranded, linear
ttgataattttgatatagaaagttatttaaaattcgaataaaaataataactcatcgacgtttaatggctaggttccaatcaactatgngacataaattcaaattcgatcacgtaacgaaa

SEQ ID NO: 3293 - DNA, 107 bp; double-stranded, linear
aggtgcccgtgatagttaanaagccattcatagttgcgttcatatttaagataccgagcagcgcgtaatacctgcagtacctctatcgcttctagataatgcggttg

SEQ ID NO: 3294 - DNA, 111 bp; double-stranded, linear
aaaatgttaaaccaaaaagtttggtgagttataatatggaatattaaatctgtagaagataaagcgaatataaagtgattaactttggtaataaagaattaacagcgaaan

SEQ ID NO: 3295 - DNA, 105 bp; double-stranded, linear
ccccgactaaatcgaacgctttaatgtaatgatttgtccgaatccccatcctgcacctgataataaggcgaatagcaagttggttcccgtngggaagccacttga

SEQ ID NO: 3296 - DNA, 201 bp; double-stranded, linear
atttattcaaaacccgccacatggggcaacggttgccatggcatgatagtccagatacatggaaaggaatacagtccggttaacactccattaaaaacctgcgggttggttaaaccatttaacctaaatgggttccaagggttaacgcggtttaaatgtttggaaaggtttncccagtttccaaaaagtttttnattcccc

SEQ ID NO: 3297 - DNA, 415 bp; double-stranded, linear
tttagactttcatcagtgttgaatatttctcctttaacggttataggtaatatttcctgagaaatatttccattctttacattttccgctgtcaattgatgacttcgataagcaaattcatcttgtaattctcttgaaacatcatacatctkggccacattttcagcacctkgaatcattgatgggtcgctcatttcaggtgcaaatgatgcacgctcataaaactcaggtaatgctgtttcgtacacagaatgcggtcgtttgattttccaaggtgctcgacttgtactttcaacaccacctgcaatatataccttgccagctccggcttggatcatgcgacatgcatattgaacactttcaagtccagacccacattgccgatcgrttgtgacgccagtattgaagcttaagc

SEQ ID NO: 3298 - DNA, 164 bp; double-stranded, linear
ttaattgcagcagagcgactagctgattcagaggtgttagtttgtacggtaataggattcccatttaggtgcatcgaccaactgcccgacgaaaagccattttgaaaaccagaangatgccgattcaaaaatgggtgccaagattgaaaatttggaccaatggg

SEQ ID NO: 3299 - DNA, 106 bp; double-stranded, linear
gtagatgccattttcacgtttcttagttattggcattttttaaatgcgatgtgtggcttctacataacgggaaattttaagttttatgaatcnacatatcaattgc

SEQ ID NO: 3300 - DNA, 102 bp; double-stranded, linear
aaaaggtgttatgagattagtaaatcantagacaagcaggtaaattaagtgatgtcgcgtcatttaaggaagcgattcacaatcgagaacacaaagtacaac

SEQ ID NO: 3301 - DNA, 127 bp; double-stranded, linear
ttaaaagtttggagattatcgtgtcgtcttcaagtatgcgttcattaattgatattggcgcaccgtataaccatgtcaaagtaccatttgnaatcagtcattggcgcattggctgccctagcgttca

SEQ ID NO: 3302 - DNA, 137 bp; double-stranded, linear
ccagctagacgattgctaaggtattggatgtttgaaacgtccatggacccaattgattaattggntgtaactcggtcaatgggtatatcctaaatgcactggcctgctggtgttcttctgggcgttgcttcggaaat

SEQ ID NO: 3303 - DNA, 399 bp; double-stranded, linear
ggattacgagacctgattagatttagcgtggaaggattatctagntactacaggagatgtatataaattaacgacgcgttaatgcaggctgatgtgatttttattggtttcccaattttcaagcttccatccctggtgctttgaaaaatgtgtttgatctacttccagtcaatgcgtttcgtgacaaggtaataggacttgtagcgacagcaggttctagtaaacattatttaattcctgaaatgcatttaaaaccaatattgagttacatgaaagcacatacgatgcaaacgtattatttattgaagagaaagatttttcaaatcaacaaattgtcaatgatgatgttgtatttcggttaaaagcgttggcacaatccacaatgcgaactgccaaagt

SEQ ID NO: 3304 - DNA, 102 bp; double-stranded, linear
caccattatttacaggacctncgatgacgtgtggtcctgtgttaagacataacataatattctacctttgtaatcagtacgggtttatctatcacagtacgg

SEQ ID NO: 3305 - DNA, 202 bp; double-stranded, linear
tcagcgttatcaatgantgactctaatgcctttttacccatttttgtaaatggaacatggaagcatagagatgcgragtcagctagcgacttaccttgacgttttgcgtattcattccagctttgttggratgagcggatataagcatctttagataatgcaccatcaactaatggatatttatgtccagttggacgccaga

SEQ ID NO: 3306 - DNA, 151 bp; double-stranded, linear
aagatagggatttacacctatacctcgttccggggaagggtcggtgttctgaaaagttggaactactcccgncaaatattaaattatgggagcgggaaggatcagggatttgacacctatgacctccattcccagggaagggaatgtgatt

SEQ ID NO: 3307 - DNA, 87 bp; double-stranded, linear
aatttcgttacctgcgccttctttttgcggtttttaaataagcgaaaatttcaggcggtaagacataacgtcccagaatagctaggg

SEQ ID NO: 3308 - DNA, 129 bp; double-stranded, linear
atgatggcaaagtcaccaaactgattgtgcacaccaatccatccatctgcgctgtaaataatggttcgcaataattttaaaataccttccgctacatttgatttaaagctggttgcgcantggactaga

SEQ ID NO: 3309 - DNA, 128 bp; double-stranded, linear
gttccttttatcgtagttggtgggactccttatcggcatcgcggctggactctaggcggtgganacggacattcaaaagggatttagttcatcccagatggatttcattttggggaattccatttgga

SEQ ID NO: 3310 - DNA, 83 bp; double-stranded, linear
gtacgattcagcataaagtacaccacatttgtcactacgacatctgtagctggtattgatcatgcaatcatgaataacgctaa

SEQ ID NO: 3311 - DNA, 85 bp; double-stranded, linear
ctgaggataaagcgtctccaagataagtctaaagatcatcataatgggcaaaaaaggtggcagcgattcggtggctgggaacaag

SEQ ID NO: 3312 - DNA, 129 bp; double-stranded, linear
attttatgtctaaatgctggaccaacagtattggctattatttggtaacgtgattactacaaaaaatggaccgttgagttcgtggcacatgattgattttgtaagtaagtatgatgcacatgggctntt

SEQ ID NO: 3313 - DNA, 82 bp; double-stranded, linear
tcacctaaaattaatcaagggacttaacattggcgagtcaaggtattgatcaagctaatggcacagttaaatgatgccaaag

SEQ ID NO: 3314 - DNA, 87 bp; double-stranded, linear
atgttatggaagaatattgagttaattggcaacgacattataccggcgattaaaaagcctttatcaaaatagtgaggggcgtcatca

SEQ ID NO: 3315 - DNA, 136 bp; double-stranded, linear
tgaacccgtcgttgcccatttgccggttcccgaaagccggcgccnacggttctccctgcctaaataggggatggaatattaaaccatctgcacctggtttaacacgctttgcaatttgagttaagacatcataagg

SEQ ID NO: 3316 - DNA, 108 bp; double-stranded, linear
cattggctgtgtccatttttaatcgttgcgagtacgtntattagcaacttggaactgccattgttaatttcagctgtctgttacatttcaaccatagtctttcacaat

SEQ ID NO: 3317 - DNA, 142 bp; double-stranded, linear
atctgaagctgggtttactagagaaggtatgtacgtgacatgaattactaatggatttattcatcgagttacatctatagtttattaaatcagatacgccaaaatgcnaattagcttacaaagatgatgcattaaatgcacg

SEQ ID NO: 3318 - DNA, 386 bp; double-stranded, linear
aacattatgttaatcaacctaatgaacgtctttataaattacgctaaacaatatacagatatgccgtttcttatcatgctggatgaagatgaaaatggatataaagcgggtcgatttttaagagcgagtgacttaggtcaaacaacagagcaaggcgaatggaagccagttattcatgatgcaatcagcgatagtttagtagtacctaatggcacaatgggtcaacgttgggaagaaggtaagaagtggaacttaaaactagaaacagaagatggttntaaaattanccctacattatcaatgacagaaggtggatacgaattagaaacaattcaattcccatactttgatagtgatggagatgggatatcatcgtccaatccnac

SEQ ID NO: 3319 - DNA, 123 bp; double-stranded, linear
acaatgaatgacatgattcgaggtggacgacccctcctattttgcataaatgctttttgaatcgccggtcataatgttcgttgnccaattaactcaatattcttcatgacattttcaaatggc

SEQ ID NO: 3320 - DNA, 104 bp; double-stranded, linear
ggcgaactgtcaattgccggtatacaacgtattttaagagctgcagaacatncgggtgttaaacgtgtggtcaatgactgccaactttggtgcagttggtttta

SEQ ID NO: 3321 - DNA, 74 bp; double-stranded, linear
gcgccggttttaacaggtaatttaaaaccaaatactgatagtaatgcattaatagtcagcaaaatacaagtatt

SEQ ID NO: 3322 - DNA, 87 bp; double-stranded, linear
tcactcagggggagatgtcaatgggtcaacattatttgacaaggtgtggacagacatgtgttatacgggaaattgggcgaccgcact

SEQ ID NO: 3323 - DNA, 400 bp; double-stranded, linear
tgccaaatgttcccataatttcattacgantcttaagtaggtggctatcattacgatgcgtggatgtgatgctgtaatttcatattgagaaataatattgcacccttcacctaacagaacaatgcggtcggaaagataaatagcttcatcaatgtcatgcgtcactaaaataatagttgattgcgttttatgttttagttgcactagttgatcctgaagtttataacgtgtaaatgcatctaatgcacctaatggctcatccatcaatataacgttaggcttatgcacatgcgctcgacatagtgccaaacgttgtttcatacccccggacagttgctcgggaaaatgctttcccctgtcttctaaatcaactaatttaagctgtgcgttaatctcttca

SEQ ID NO: 3324 - DNA, 106 bp; double-stranded, linear
gaaaccatcgattgtagcacgaaccatgttggattggtgtgtttgnatcctaatgtatttacttaagatatcagtgatacctgtctaattgcaagtacggtcagga

SEQ ID NO: 3325 - DNA, 113 bp; double-stranded, linear
tctgaantcgctgtctgaatctggaatcactgtctgaaatccgaaatcgctaatctgaaatcctgaaatccgctaatctgaaacctggaagtcgctggtctggaagccctgaa

SEQ ID NO: 3326 - DNA, 78 bp; double-stranded, linear
tgtcacgtacttgctgttcaacaaatacgtcttactggacgtgcacctcattcttcatcatagccttcttcattaacc

SEQ ID NO: 3327 - DNA, 119 bp; double-stranded, linear
aattgaaaattatcttactgcggtttttaggggtttatgtcccagcctcttactcnaattatattcactatccattagaccaaatgggccatttccaataatcccgcggtggtttccga

SEQ ID NO: 3328 - DNA, 71 bp; double-stranded, linear
gtgttaaaacgtcacgacgtttgtttaaaatgatgcgtcataatgtctacactttgcttgcgatcattcat

SEQ ID NO: 3329 - DNA, 70 bp; double-stranded, linear
ctgacgaaccttgcatcatttaactgtccattagcttgatcaataccttgactcgcaatgttaagtcctt

SEQ ID NO: 3330 - DNA, 69 bp; double-stranded, linear
ttcccattctgcaaatccaccataaatactacgcgacgcaggaacccgaaccaattcgcgccaatctcg

SEQ ID NO: 3331 - DNA, 70 bp; double-stranded, linear
ggacactaacattaatatggactggtaatgttgctgttaataaactcataccaaatcctgggcatctctt

SEQ ID NO: 3332 - DNA, 82 bp; double-stranded, linear
ccttgggcaccttcaatttgcatattacgacgttttgcagcttggttcaattggcaataactacacctagtgcagttggatc

SEQ ID NO: 3333 - DNA, 76 bp; double-stranded, linear
ataaaataattagaactctaacattggtttaactaatgtttagactttttgtggtttgtaaaaacaagtatattga

SEQ ID NO: 3334 - DNA, 74 bp; double-stranded, linear
tggtaagttgaataaagtattgaaatcgttgccaatatctttataccgttggttcctggcatttattgggaggc

SEQ ID NO: 3335 - DNA, 74 bp; double-stranded, linear
agatagttatgcgcagttaaaaacggtgaaatgtatttgcaataatatgcatataggcaccatacgagtaaggg

SEQ ID NO: 3336 - DNA, 76 bp; double-stranded, linear
ttgaatcattgttaaaaatggaattaaagttgctagtatctgtcgggttttgaaataggtcataggagaaaacagg

SEQ ID NO: 3337 - DNA, 72 bp; double-stranded, linear
ccaaagaggcgttattaagctattgataaaagttatgttactaaaaaatgtatttaaataagtagtacctaa

SEQ ID NO: 3338 - DNA, 75 bp; double-stranded, linear
ataagtcgttctaccgtatagccgtcattattaatcacaaataataccggtttaatatgctgtctggtcatagtt

SEQ ID NO: 3339 - DNA, 72 bp; double-stranded, linear
ttcatcaaagtattccaatgggagaaaaagcacaataacattatcactggatgctaaatctaaaggaacctc

SEQ ID NO: 3340 - DNA, 77 bp; double-stranded, linear
gtaaaaatattttaatgaatgtcttcactggagaaccattgacaacctggtacaagtgggattattggcgttatttt

SEQ ID NO: 3341 - DNA, 67 bp; double-stranded, linear
aaccaaggatggattgctattttaatccttggttgctctttattttatttaaattgtagaacctaga

SEQ ID NO: 3342 - DNA, 74 bp; double-stranded, linear
ctggcaaaagcacgttttacaagcatcaatccattaattaataattccattaaatgtagattcacagggatatg

SEQ ID NO: 3343 - DNA, 415 bp; double-stranded, linear
gtttgatcattagagagatatagatatgccgtagaaaataatatgtcatttgcggatatcatggttaaagaagaaatggaattaagcggtaaatcacgtgatgaagtgcgagcgaaatgaaacaaaatttagatgtcatgcgagacgcataatcaaagggacgacaggtgatggggttgaaagtgtacggtctacactggtcatgatgctgctaaactacgtgattataatgaaacacatcatgctttgtctgggatatgaaatgattgacgcacaagggtgccattgcaacaaatgaagtcaatgctgccgatgggtattatttgtgcacgccaacagctggttcctcgggtaccattcccggtggcacttttaaattagaaaaaacactggatngaaccagaagagccaatgn

SEQ ID NO: 3344 - DNA, 84 bp; double-stranded, linear
tcctataccaccaccgtcaacagctcctgccatcgatcgtactttcaataagtccaataatcgcagtggtaatttctaatacta

SEQ ID NO: 3345 - DNA, 474 bp; double-stranded, linear
cgggaggtgttaantcttcacaaaatgccgtactattctttgatgnaatccatcaaattatcggttcaggtgccacaggaagtgattcaggtagcnaagggttatctgatattttgaaacctgcattaagtcgtggtgagatttctattattggtgcaacaacacaagatgaatatcgaaacaatattcttaaagatgctgcattaacgcgcagatttaatgaagtgcttgttaatgaaccaagcgctaaagatactgttgaaattttaaaaggtattcgcgaaaaattcgaagaacaccatcaagtaaaattaccagatgacgtattaaaagcatgtgttgacttatcaattcaatatattccacaacgattattaccagataaagcaatcgatgtgttagatattacagcagcacatttatcngcgcaaagnccagctgtcgataaagttgaaactggagaacgaatttctg

SEQ ID NO: 3346 - DNA, 64 bp; double-stranded, linear
aaaattaataactccttggttattgatatgcctaaagaagaaggtacaatacaactaacattag

SEQ ID NO: 3347 - DNA, 89 bp; double-stranded, linear
aggaataacttgatattgatgataaaatcgtcaaacggcactaatatttaaaaaacaaatgttttaagttgttgatttaaaatattaat

SEQ ID NO: 3348 - DNA, 107 bp; double-stranded, linear
ataacttgtactgcttcccattaatcactgtgtctcttcaccaggagctggcatttctttaaagaacanttctgataaaggtacaatttcaccgggcataacttcat

SEQ ID NO: 3349 - DNA, 74 bp; double-stranded, linear
caacgcatcctgcacttttacctattcctgaatcaccggtaattagtacaccaacaccgtaaacatctactaaa

SEQ ID NO: 3350 - DNA, 62 bp; double-stranded, linear
agatgcacctacttctaactgtcgccaacatcgccgcaatcatttcaaaactacgttctgta

SEQ ID NO: 3351 - DNA, 73 bp; double-stranded, linear
gctgcaaacaacaaactatttttgattaaattgtggatatgatggtaaccaaccaagtctagcggctaaaaca

SEQ ID NO: 3352 - DNA, 77 bp; double-stranded, linear
attgaacgcaagatttcgatatagaacatctagcgacgtcgattcgcaaggttgaaccatctacattaggtgaggaa

SEQ ID NO: 3353 - DNA, 59 bp; double-stranded, linear
taatcaacacgaggagatgctatttaatgtcatctgacacaaacagtttagcacataca

SEQ ID NO: 3354 - DNA, 59 bp; double-stranded, linear
ttatgtaaccgacgaatgctgcgatagtgctacgccatcaccgccagctaatccgattg

SEQ ID NO: 3355 - DNA, 59 bp; double-stranded, linear
taactatacctttagggttactaccacgcttaggtaggtcataacctttaaccacatct

SEQ ID NO: 3356 - DNA, 59 bp; double-stranded, linear
aataacgctaaacctaaaatgctaaataatccgccgaacaacatgccgttgtttgttga

SEQ ID NO: 3357 - DNA, 77 bp; double-stranded, linear
ccagaaccacccacgccctttgaatatgggaactcaaaacgatctactggctgatgtaattacccctgttttgattg

SEQ ID NO: 3358 - DNA, 59 bp; double-stranded, linear
aagttaggtctagggaacatcgataaattaccagtagtaaatgcagttgaacaaccaga

SEQ ID NO: 3359 - DNA, 59 bp; double-stranded, linear
catgacctttaaattgcatatcttctgcatcaggtgcatcgcttttaacaataacgtca

SEQ ID NO: 3360 - DNA, 59 bp; double-stranded, linear
acgcgacaacaccgccctcaactaaagtagaagcaccgcaacaaacagcaaatgcgaca

SEQ ID NO: 3361 - DNA, 66 bp; double-stranded, linear
gatttgatcgaattgaacgaacatttgcttctcaaacgattgcatctattaaagaagtatgtctag

SEQ ID NO: 3362 - DNA, 58 bp; double-stranded, linear
ggttgcacatcttttactacaaatttcgctggtaaagatgttgcaaaagtatgtccgt

SEQ ID NO: 3363 - DNA, 58 bp; double-stranded, linear
ccttgaaacggcaacatttttgggtccttctccatcattttatttaaaagcgcattat

SEQ ID NO: 3364 - DNA, 58 bp; double-stranded, linear
ttgagaatttaggaggttaatgcgttgattaaaagtggcaaagcacgtgcacatacga

SEQ ID NO: 3365 - DNA, 58 bp; double-stranded, linear
gtttttttattttggataaaaggagcaaacaaatggatattaactggaaattgagatt

SEQ ID NO: 3366 - DNA, 58 bp; double-stranded, linear
attcatcggtaatgacattatttttactttgtaatttcagtaacagttgatcatcatg

SEQ ID NO: 3367 - DNA, 58 bp; double-stranded, linear
taaattaacagccggatgaaatgaaaggtgctacatgcacaatcagtaatatcggttc

SEQ ID NO: 3368 - DNA, 58 bp; double-stranded, linear
tacctactggtgagattggcgaacttgcaattaaggctaaaaatgtcacgccaggata

SEQ ID NO: 3369 - DNA, 58 bp; double-stranded, linear
ttaaacggagaaggctttactttacatgttgaggaaggtcaagaagttaaacaaggtg

SEQ ID NO: 3370 - DNA, 68 bp; double-stranded, linear
ctgctaaactacgtgattataatgaaacacatcatgtctttgtctggtatatgtaaatgattgacggc

SEQ ID NO: 3371 - DNA, 399 bp; double-stranded, linear
attaccaacagcgaaaatattgaaaagctgtaaaaaagctggtgcasmcmtacttggattgagaatttaggaggttaatgcgttgattaaaagtggcaaagcacgtgcacatacgaatattgcacttataaaatattggggtaaaaaagatgaagcactaatcattccaatgaataatagcatatctgttacattagaaaaattttacactgaaacgaaakcacttttaacgaccagttaacacaggatcaattttggttgaatggtgaaaaggttagtggcaaagaattagagaaaatttcaaaatatatggatattgtcagaaatagagctggcatcgattggtatgcagaaattgaaacgacaattttgtaccaacagcagcagggttggtcatcg

SEQ ID NO: 3372 - DNA, 58 bp; double-stranded, linear
atttcaacaactttaaagcacgtataatgatgattttcagacttgtacaaaggagaaa

SEQ ID NO: 3373 - DNA, 57 bp; double-stranded, linear
aaaccgagcagcgcagtaaacctgcagtacctttatcgcttctagataatccgattg

SEQ ID NO: 3374 - DNA, 57 bp; double-stranded, linear
agtacgaatattacctttatttaatgggtgagctaagttacttttcatttcttcgtg

SEQ ID NO: 3375 - DNA, 70 bp; double-stranded, linear
ggtgaagtataactttgtaatggcagcgcacttaatgactgccaataattgtgaccaacaactaacagac

SEQ ID NO: 3376 - DNA, 57 bp; double-stranded, linear
ttccaaacttcattaggtgatagctttaatttcaaggctggcaatcgccataacaag

SEQ ID NO: 3377 - DNA, 70 bp; double-stranded, linear
tccttcaaagtcaatggatttgatcctcagaggactcagtgtatcctccaagtgacctggctcgcatcca

SEQ ID NO: 3378 - DNA, 56 bp; double-stranded, linear
atgaatcattaagcctttcggtgcatatgctgcaagactttgaccagcatgaccat

SEQ ID NO: 3379 - DNA, 56 bp; double-stranded, linear
ccaacgactgcgccaatattaattgttgcgcccatcataacgacagcaccatcttc

SEQ ID NO: 3380 - DNA, 57 bp; double-stranded, linear
acaaaagcatcaagctgttgaaacaatcaatgatagcattcgagattatttagttag

SEQ ID NO: 3381 - DNA, 56 bp; double-stranded, linear
catatagttttgctcactaccataacctgcatcagctacaaataaccgaagtattt

SEQ ID NO: 3382 - DNA, 105 bp; double-stranded, linear
gaacacacaggcaacccaaagcagtgacggcgaaanttggattgatcttgcagcattgaagaagatcgcgatgactatacaatcaatatcgagtagaagaccgat

SEQ ID NO: 3383 - DNA, 106 bp; double-stranded, linear
ngtatgtgaaaactatttggcgatattttagtgatgagcctcagtgatcctggttcctggttatcacctctgctagtttagtaccgatggtccaagattgatgagc

SEQ ID NO: 3384 - DNA, 57 bp; double-stranded, linear
ttcttcgtcaagatcaatctcttcaagtacaatctttaataccttctgcacccattt

SEQ ID NO: 3385 - DNA, 65 bp; double-stranded, linear
cgggcatcttaaagccgatgtttatcctgtaatcctccaaaaggaaacatgtacctcaattagag

SEQ ID NO: 3386 - DNA, 71 bp; double-stranded, linear
catttttaattatttctatttgctttttaaccacttctctgactgcttccgaatcatttttcttaactgca

SEQ ID NO: 3387 - DNA, 55 bp; double-stranded, linear
ttagaaaatgataaacgtaaagcagtaagtgctgaagaatataaaaaagctgacg

SEQ ID NO: 3388 - DNA, 56 bp; double-stranded, linear
tcttcgacaactttaataatattagccaacgcagtgtccccgccaacttttgttgc

SEQ ID NO: 3389 - DNA, 56 bp; double-stranded, linear
atttattaacgattaatgacgctggcatgccaattccagatgatcatcgtcgtatc

SEQ ID NO: 3390 - DNA, 70 bp; double-stranded, linear
aaatgctatgtacccactttagatgaaattttagtaacgttatggcccgaaatgccaactattatattga

SEQ ID NO: 3391 - DNA, 59 bp; double-stranded, linear
caaacgcaatagctggtgacttaactgcgggcacttggcatgtggatggcaatacttcg

SEQ ID NO: 3392 - DNA, 55 bp; double-stranded, linear
gcatctactgggaaacgattacaaattggtgatttattacaaaagccaactgtat

SEQ ID NO: 3393 - DNA, 55 bp; double-stranded, linear
tttataaatatcccagtctgaacgcgattcccataacggatcaatggcaggattg

SEQ ID NO: 3394 - DNA, 55 bp; double-stranded, linear
tgcttacgctcagtgacataatctaatgtggcacgtaaagcgccaccataccacc

SEQ ID NO: 3395 - DNA, 58 bp; double-stranded, linear
agtcaccatttgttggtacaggttatggaacacgttgcagcacgtgattctggtgcgg

SEQ ID NO: 3396 - DNA, 55 bp; double-stranded, linear
caaatgcatttaaaaccaatattgagttacatgaaagcacatacgatgcaaacgt

SEQ ID NO: 3397 - DNA, 54 bp; double-stranded, linear
tgttgatgagtcgtgttttatctcaagatgtgttactcaaaaagttatagaaga

SEQ ID NO: 3398 - DNA, 54 bp; double-stranded, linear
cttcgtcaagatcaatctcttcaagtaaatctttaataccttctgcacccattt

SEQ ID NO: 3399 - DNA, 55 bp; double-stranded, linear
aatgaaaagctagctgtagttgcaagaaaaactggcttagcgatggcagttggat

SEQ ID NO: 3400 - DNA, 54 bp; double-stranded, linear
cggttgccctataaaagtattgtttttgtataatgctaaatcataagcaccaaa

SEQ ID NO: 3401 - DNA, 55 bp; double-stranded, linear
taaaaatcgcgcacttaaaccgcttatgacaatcattattaccgcaatatgcttg

SEQ ID NO: 3402 - DNA, 54 bp; double-stranded, linear
ggcacctccttggattatttttcttctactgttactaagtgcttaactttgttg

SEQ ID NO: 3403 - DNA, 58 bp; double-stranded, linear
gataagtctaacaagtggcacccataatcgattaaactaccgccaccttgcaacgttt

SEQ ID NO: 3404 - DNA, 65 bp; double-stranded, linear
tcgttttcgtccccaaattctgccaacttattcatgaacttatctagcgctattgttctttgtct

SEQ ID NO: 3405 - DNA, 55 bp; double-stranded, linear
aaatttcagcaccaattgttattggacgacaccatttagatgctggttcagttgc

SEQ ID NO: 3406 - DNA, 56 bp; double-stranded, linear
tcgatttcagcggaacacatgtaacgttagcacaagccatgaaccaattaggtggc

SEQ ID NO: 3407 - DNA, 74 bp; double-stranded, linear
aattgctaatggtcaagtatggacgtgatcattgttggtactacttattgctgaaactgttaaagattagaagg

SEQ ID NO: 3408 - DNA, 68 bp; double-stranded, linear
tgatttcacacttgataacggatacttcgaagagatacatcagcagcgttcagctcagatagtgctca

SEQ ID NO: 3409 - DNA, 54 bp; double-stranded, linear
tatgattagaaaaaggggaatttttatggagtataagagttactatgattcgcc

SEQ ID NO: 3410 - DNA, 54 bp; double-stranded, linear
tatctttcatcattgaagaagatcgcgatgactatacaatcaatatcgagtata

SEQ ID NO: 3411 - DNA, 53 bp; double-stranded, linear
ttgaagtgcacgaatcgaattattgtaagcagtaatacttgccggcttcttac

SEQ ID NO: 3412 - DNA, 63 bp; double-stranded, linear
tagccgatggaaccccataacggttgccctataaaagtattgtttttgtatagtgctaaatca

SEQ ID NO: 3413 - DNA, 53 bp; double-stranded, linear
actaccattgcttgttccggtttcacaactggttcagtatcatttacaactgc

SEQ ID NO: 3414 - DNA, 62 bp; double-stranded, linear
atgctgttgtaaacggtaatacaacatacctgcccaacccggtaacgccaaaaaatgtcctt

SEQ ID NO: 3415 - DNA, 55 bp; double-stranded, linear
acttagatcaatcacatgatgcctcacggaatccattatttgaaggtcatgttag

SEQ ID NO: 3416 - DNA, 53 bp; double-stranded, linear
ttagttccagcaatacctgctacagttgctgcagatgcttctttcacccatgg

SEQ ID NO: 3417 - DNA, 59 bp; double-stranded, linear
tgatttaggtgcaaaaattgtaggtatcgctgaggcttacggtgcattacacgatccaa

SEQ ID NO: 3418 - DNA, 53 bp; double-stranded, linear
cgtggtcaccatcaccaattgctcgatctaattcagtaattcagattcatgtt

SEQ ID NO: 3419 - DNA, 55 bp; double-stranded, linear
tggacctactgcaataactgaacgtcctgaatagtcaacacgtttaccagtaagt

SEQ ID NO: 3420 - DNA, 53 bp; double-stranded, linear
tgtctccggtaccgtttgcaccaggaataaagatgagcacgggtccttgtccg

SEQ ID NO: 3421 - DNA, 72 bp; double-stranded, linear
aaattaagaaaattcattgccagataatttagataaataattaaaacttagaccattcaccccaatccctga

SEQ ID NO: 3422 - DNA, 54 bp; double-stranded, linear
catatgttaaatggactcgctagatttaagtcgcaatagtagcggccgtttctt

SEQ ID NO: 3423 - DNA, 52 bp; double-stranded, linear
cacgtttcaaacctaaaagatgctaaaaatttctcttaattcttgtgcaata

SEQ ID NO: 3424 - DNA, 54 bp; double-stranded, linear
atcgcctaaccaagatgcaccatcggtgattttatcgcctgccgcttcaaccat

SEQ ID NO: 3425 - DNA, 59 bp; double-stranded, linear
aatagaaaatgtacgtagcggtatgatgaggatttcgcagactagtttagggtcaagtg

SEQ ID NO: 3426 - DNA, 52 bp; double-stranded, linear
ccaacgccagatccagaaccaagtccagacccagaaccggaaccaagcccag

SEQ ID NO: 3427 - DNA, 52 bp; double-stranded, linear
ccatattaatggttatgtttatgtgaatgcttgcttgctggacttgtctttt

SEQ ID NO: 3428 - DNA, 52 bp; double-stranded, linear
taaaacagagattgatactgcagaagataactgtatctctccatctactgta

SEQ ID NO: 3429 - DNA, 52 bp; double-stranded, linear
tgaaaatccacaagtcgcacgtacagtgtttgaaaaaggtattatggcggca

SEQ ID NO: 3430 - DNA, 76 bp; double-stranded, linear
ataattcttccaaatatatgaaaatggatttgttctttttttataaaaatcttatgctttttaactaattgtaaga

SEQ ID NO: 3431 - DNA, 60 bp; double-stranded, linear
ctgcgggggataactgtatctctccatctactggtaagtcgtattagaactaaagcggct

SEQ ID NO: 3432 - DNA, 52 bp; double-stranded, linear
ggcttcaggctcattgataggtaaaagttgcaaagcctgcaaagcgattggg

SEQ ID NO: 3433 - DNA, 69 bp; double-stranded, linear
tcgcacgatacgcctccgaatgaagaaggtttattgtgcgattcttttattgttaaattttaaattttt

SEQ ID NO: 3434 - DNA, 51 bp; double-stranded, linear
gatcgctatccattagctaaatttaaacgttcaaactcaggtacatgttac

SEQ ID NO: 3435 - DNA, 51 bp; double-stranded, linear
tatagctactgctgcagctgcggccattgcagatgctgaaccaacttcagc

SEQ ID NO: 3436 - DNA, 70 bp; double-stranded, linear
attaaagccaacattaatttatccactattaacaataacggctacaggcttattaatgatttataccttt

SEQ ID NO: 3437 - DNA, 51 bp; double-stranded, linear
tttgtttgttgattcttctccacctgtttcaggtagttcagatttcttaga

SEQ ID NO: 3438 - DNA, 51 bp; double-stranded, linear
gtgaattccgtaattacattttaggcttgattttctatcgcttcttatctg

SEQ ID NO: 3439 - DNA, 51 bp; double-stranded, linear
ttaagacaggttccttatgggactctaacaacgtatggtgctattgccaaa

SEQ ID NO: 3440 - DNA, 55 bp; double-stranded, linear
cactagaagaaacggattcatcagctattggtatcgattaccatactgctgtgga

SEQ ID NO: 3441 - DNA, 77 bp; double-stranded, linear
cttctggcaatagaccgcgagttactgggggcaaaaccagtgtgtaaaaccggaactactatgaggggcatgaaagt

SEQ ID NO: 3442 - DNA, 55 bp; double-stranded, linear
gttcggttgtgacagtcagtggacgcgttaccaaatgggcgggaattaaagcaaa

SEQ ID NO: 3443 - DNA, 51 bp; double-stranded, linear
atgaactttgggataaaggtgatgcccaaactttccgtaactcatgatgat

SEQ ID NO: 3444 - DNA, 51 bp; double-stranded, linear
caacgcagcaaagcggagtggccctttaccttcacagaataatggtctaat

SEQ ID NO: 3445 - DNA, 50 bp; double-stranded, linear
accgagcagcgcactaaacctgcagtacctttatcgcttctagataatcc

SEQ ID NO: 3446 - DNA, 50 bp; double-stranded, linear
ccaatgcaacgatccagttattgtgttggcgcaattgattaatagtattc

SEQ ID NO: 3447 - DNA, 50 bp; double-stranded, linear
gcgcatcatatcccattgcaccgataagatccttcttaccttctacaagt

SEQ ID NO: 3448 - DNA, 60 bp; double-stranded, linear
gttcttacttctttatcgtggctccaacgtgctctgtacattttttcccatctctctact

SEQ ID NO: 3449 - DNA, 50 bp; double-stranded, linear
caacaccaccgacaccagaagtaccaagcgagccggaaacaccaacaccg

SEQ ID NO: 3450 - DNA, 88 bp; double-stranded, linear
aaaggccgtattgaatgaatcacactagcagcggttgctcaggacatttaaatcacttatttatcacggtatatgaggggatttgagg

SEQ ID NO: 3451 - DNA, 50 bp; double-stranded, linear
tgcaaaacgttatgaagtacaagttgatggaagcaacaaagtaagtgcgn

SEQ ID NO: 3452 - DNA, 64 bp; double-stranded, linear
cagttaagtcaccagctattgcgtttggtgatcttaagcaggcgtggattatcaagtttgggta

SEQ ID NO: 3453 - DNA, 131 bp; double-stranded, linear
tcgtaaacaatatactatctcaacatttattcatccaatggagataacgtattgcgcggtttaacaggtaatttaaaccaaatacggtagtaatnattaatagatagcaaatcaagtataaagaataagta

SEQ ID NO: 3454 - DNA, 50 bp; double-stranded, linear
ttaaaaatgcagttatggcctctaaaatcgtattaagcatattagcgccc

SEQ ID NO: 3455 - DNA, 51 bp; double-stranded, linear
tgctacatggcgttacggtcaagatcgtcaacgattgatgggtacaattga

SEQ ID NO: 3456 - DNA, 50 bp; double-stranded, linear
acaaactgccaacgattggtcgtgtgaatcatccagtggaagaagcgcan

SEQ ID NO: 3457 - DNA, 50 bp; double-stranded, linear
aatcacgtgagaaggatacagctattagtatcggtatcatcgcattgatt

SEQ ID NO: 3458 - DNA, 51 bp; double-stranded, linear
gcaatggcacctttgactgggtcaatcatttcatatccagacaaagcatgg

SEQ ID NO: 3459 - DNA, 50 bp; double-stranded, linear
gggccaacaaatcggaaactgccaattggacggttgccgtcatcaaaccc

SEQ ID NO: 3460 - DNA, 68 bp; double-stranded, linear
tgcttccgctagaggatccggtattgctagtcaattactacaccatttaaattgtggaagcaaaagct

SEQ ID NO: 3461 - DNA, 51 bp; double-stranded, linear
tggtcttcgcaatccacggatataccttagtaccaggtaattgaccacctt

SEQ ID NO: 3462 - DNA, 56 bp; double-stranded, linear
aagctattaatgtaatttatcaattgattgtgcaacggacatcatctacaagaccg

SEQ ID NO: 3463 - DNA, 50 bp; double-stranded, linear
ataccaaatgtgagaaactggagcagcaanttcaatgtgacccattcttt

SEQ ID NO: 3464 - DNA, 50 bp; double-stranded, linear
tctttacggcgtggttctaatcgcatctttttcaatctaagtgcgtttnt

SEQ ID NO: 3465 - DNA, 57 bp; double-stranded, linear
aaagaagattggaacgtgtattgacgactgcacccaggtatgggtgttcgcccgaca

SEQ ID NO: 3466 - DNA, 63 bp; double-stranded, linear
acatccgaaagatgacttgtttaaaaaagcagagcatgatttgcttactatgattacacgcgg

SEQ ID NO: 3467 - DNA, 57 bp; double-stranded, linear
taccgatgatttccgagacatagaccggcctgtctgggggtcaactggaacttggtc

SEQ ID NO: 3468 - DNA, 59 bp; double-stranded, linear
tgttcctaatatttatgttgtaaaaatgtacaatctaattaaagcaatagtcttgggca

SEQ ID NO: 3469 - DNA, 57 bp; double-stranded, linear
tccatgatcgttcaacatttaaatacacaacttaataagtatcgtgtacaagttatg

SEQ ID NO: 3470 - DNA, 59 bp; double-stranded, linear
ccctgttcaggctatcctctaaagtgacgatatagaatagcgattaatatcgcgatagt

SEQ ID NO: 3471 - DNA, 50 bp; double-stranded, linear
tacgccatcancgccagctaatccgattgcgacacctaatgcgaaatcat

SEQ ID NO: 3472 - DNA, 54 bp; double-stranded, linear
aacgtcatcaaatggaagtacgtgacgttcactactctcactatggccgtatgt

SEQ ID NO: 3473 - DNA, 56 bp; double-stranded, linear
taataggcattcccattaggtgcgtcgacaactgcaacgcaagcatttgaaacaga

SEQ ID NO: 3474 - DNA, 55 bp; double-stranded, linear
ttttaagaatgtcgcgttatctgcgcccattggattgacatacttcatacgtata

SEQ ID NO: 3475 - DNA, 54 bp; double-stranded, linear
gcctttaggtaaaatgggcagaaatgctaatcattttggcggcgaaatgaaaaa

SEQ ID NO: 3476 - DNA, 50 bp; double-stranded, linear
aaancattcgcaatcgaccataattttttatgtaattcagcttgttgctg

SEQ ID NO: 3477 - DNA, 50 bp; double-stranded, linear
ggangaccattaatcgatatcggtacacacgctttagatttaacgttatg

SEQ ID NO: 3478 - DNA, 60 bp; double-stranded, linear
tgcctccttacgccatgatgcttattcaaagtaaattgctttgccggactttgcagactg

SEQ ID NO: 3479 - DNA, 77 bp; double-stranded, linear
ggtctttcagctgctaacgagttcctgttactgttcatgtctatcactttgcgttccctcacactacttatacgaca

SEQ ID NO: 3480 - DNA, 50 bp; double-stranded, linear
caagtatcatatggacggctcgcccaacacaaaacaagnccaagcaaaac

SEQ ID NO: 3481 - DNA, 62 bp; double-stranded, linear
attaaacaacatagctcggctaatcctttaaagcttttgagtttttctgttgtagaacaaga

SEQ ID NO: 3482 - DNA, 51 bp; double-stranded, linear
tgtggctagctgtttcttttttaggtgctgtgtaggagatgaactgatcgt

SEQ ID NO: 3483 - DNA, 54 bp; double-stranded, linear
gcagtttataagtagagagacagctgatcatgagataaaaatgggtaaatattt

SEQ ID NO: 3484 - DNA, 55 bp; double-stranded, linear
ttatctatcacagtacgaatcccccagagtaccgattgtgacagcaacttctgcg

SEQ ID NO: 3485 - DNA, 52 bp; double-stranded, linear
atctctggttcgattcccgtcgagaccggcatcattacatgtttattatggg

SEQ ID NO: 3486 - DNA, 50 bp; double-stranded, linear
tgtgtcacgataataggcgtaatatcactctttggcatgattgccggatg

SEQ ID NO: 3487 - DNA, 67 bp; double-stranded, linear
tatttttgatcacactcaacgcacaaacgaatggcctttaccttcacagaataatggtctaatgtaa

SEQ ID NO: 3488 - DNA, 50 bp; double-stranded, linear
taggtggtcaattacctggtactaggtatatccgtggattgcgaggacaa

SEQ ID NO: 3489 - DNA, 60 bp; double-stranded, linear
caattgtacttcataacgttttgcatttcgccaccttcaccactatattttcccatggtc

SEQ ID NO: 3490 - DNA, 50 bp; double-stranded, linear
ctaaactgattgttttacgtaacgtttcatcggcttctttcgcttctatc

SEQ ID NO: 3491 - DNA, 52 bp; double-stranded, linear
tcgatttacctttcatcattgaagaagatcgccatgactatacaatcaatat

SEQ ID NO: 3492 - DNA, 52 bp; double-stranded, linear
aaccttttcacaaatatcatataactcttctaatgggataatctcttcatgt

SEQ ID NO: 3493 - DNA, 67 bp; double-stranded, linear
ggttttaaaccgtcacgaacatctggcaatgcacgagcaacgtacatacgtatctaaagttacgctt

SEQ ID NO: 3494 - DNA, 50 bp; double-stranded, linear
tacgttatgttatgtaaataacagttaattataccggtggtctgggtcga

SEQ ID NO: 3495 - DNA, 60 bp; double-stranded, linear
cgcttgttgttgtactttggcagttcgcgttgtggattgtgccagcgcttttaaaccgta

SEQ ID NO: 3496 - DNA, 56 bp; double-stranded, linear
ggcaccggcttctctattgcttctttagcatatctgcagctctctcaagggacatg

SEQ ID NO: 3497 - DNA, 59 bp; double-stranded, linear
cacctttaggatacgcgtctaaccactgtgtcgcgtctctatatatcgctaaacacgta

SEQ ID NO: 3498 - DNA, 55 bp; double-stranded, linear
aagtaatatctgaatgcgtatattgtctaatttcaaattctacagacatcgacgt

SEQ ID NO: 3499 - DNA, 50 bp; double-stranded, linear
antgtacacgtccatcttcacatgacaacaacgatattttgaccatcaca

SEQ ID NO: 3500 - DNA, 56 bp; double-stranded, linear
gtgctaatgcggcaccttacttgtttcagcaccagccattgttgcaattggcatta

SEQ ID NO: 3501 - DNA, 52 bp; double-stranded, linear
tgtgtgcctttaagttgttgatgacacgcattcacgacaacagacatgacac

SEQ ID NO: 3502 - DNA, 50 bp; double-stranded, linear
ctggcttcaatggcaacttctgtacctggtaccaatgggcgatgaccgat

SEQ ID NO: 3503 - DNA, 50 bp; double-stranded, linear
tgtccgacttggcggnatcgtaatttagcgcntgtaattctaaagggacc

SEQ ID NO: 3504 - DNA, 64 bp; double-stranded, linear
aaccttcatattgcttctaataagaaaccgagcagcgcaccaaacctggcagtacctttatcgc

SEQ ID NO: 3505 - DNA, 50 bp; double-stranded, linear
tattgatgttgaaaactgttatgtcctttcgatgggccaacacnaanata

SEQ ID NO: 3506 - DNA, 51 bp; double-stranded, linear
gaatatggtatcaatggtatgcactaaggctttatgaaattcatttaaaat

SEQ ID NO: 3507 - DNA, 64 bp; double-stranded, linear
cggttttaatcggtaaattaaatatggatgagtttgcaatggtgttcacagaacatctatttaa

SEQ ID NO: 3508 - DNA, 50 bp; double-stranded, linear
caaggccttgtttttaaagcagctacagttggcaatatgtccactcatgt

SEQ ID NO: 3509 - DNA, 50 bp; double-stranded, linear
cagatgcaaattgacatggtcatcaacatcngtncattaaaagatggacg

SEQ ID NO: 3510 - DNA, 94 bp; double-stranded, linear
acaagagggtcacccagctcggtcgattcccaccgccacatcatgatatttattcatagagtttacgcactgtacatgattgaatgcgataaag

SEQ ID NO: 3511 - DNA, 54 bp; double-stranded, linear
actcaacaatggatattcttacactgaaaaatgggtaatggtgcaaacatagta

SEQ ID NO: 3512 - DNA, 50 bp; double-stranded, linear
ccggatgcacatttgatgactgaagtccgcgataaagggacaanagtcan

SEQ ID NO: 3513 - DNA, 58 bp; double-stranded, linear
gcattaaattgaaacaatcggatttacaattttctcttaatgctgtcgtctacacagc

SEQ ID NO: 3514 - DNA, 66 bp; double-stranded, linear
gtgttcgtgttcatgcaaggtgaatgcgagtgatctgttggtatgggctttatgcatggcaatctg

SEQ ID NO: 3515 - DNA, 50 bp; double-stranded, linear
atgccactgataatgcnnctgaacttattgatgacttctcattagactat

SEQ ID NO: 3516 - DNA, 50 bp; double-stranded, linear
cggcgacaaagagtaaacacagcggagggacaaagcccgcgactagcaac

SEQ ID NO: 3517 - DNA, 51 bp; double-stranded, linear
atgcctatgtagcaccgagtaccgataccgaacacttagctacgccagttc

SEQ ID NO: 3518 - DNA, 50 bp; double-stranded, linear
gagcatnaaggtgatttngatcgctatccgttagctaaatttaaacgttc

SEQ ID NO: 3519 - DNA, 64 bp; double-stranded, linear
gattggtatttagctttaaatttatggttggaatagtaggtggcatatatcgctgttagtatcg

SEQ ID NO: 3520 - DNA, 73 bp; double-stranded, linear
tcttcaatctcaggggcatctactaacatatcatccagtcaatattgcgtcacattgttaatcggttccgatc

SEQ ID NO: 3521 - DNA, 75 bp; double-stranded, linear
tcaaattggcaattggtacgaatgtcgactgtactaacatcattagctcatgattgccaggtgatttcatggatg

SEQ ID NO: 3522 - DNA, 57 bp; double-stranded, linear
ttccaatgggcttctgactttggcggttttagtgcttgggttgccggcggttttgga

SEQ ID NO: 3523 - DNA, 72 bp; double-stranded, linear
tggtggaggttttgttttttccgtgtcggtttttgttttcgtcttggtttcttttgtttttgtgttctcttt

SEQ ID NO: 3524 - DNA, 51 bp; double-stranded, linear
atatcacaatataccggtttatatgctgtctaatcatagttgaatagtgac

SEQ ID NO: 3525 - DNA, 59 bp; double-stranded, linear
tagaccgtcgtggatagttttgggtacggtaaccaatttattttgaagagaccatcctc

SEQ ID NO: 3526 - DNA, 50 bp; double-stranded, linear
taataacgttgccctcccatgtatatcctaccaacatgacatcttgtaca

SEQ ID NO: 3527 - DNA, 52 bp; double-stranded, linear
ttcccaacgagcagtcgcatgcggtactgccacggcattttgatgcaggcct

SEQ ID NO: 3528 - DNA, 50 bp; double-stranded, linear
aaagaaangatngnnngnnngnanaaannnnnccatnnnnntaaaaaaaa

SEQ ID NO: 3529 - DNA, 62 bp; double-stranded, linear
cattagcctcatccccttcgtttagactcgctatagatgcactaaatggcgatatatttttc

SEQ ID NO: 3530 - DNA, 50 bp; double-stranded, linear
cactaccacaaaaattataggtgttgaccttcaggngcaagtagtatgat

SEQ ID NO: 3531 - DNA, 50 bp; double-stranded, linear
gaatgcaaaatccatttgtaagganatcgaatggtttagtanctcgtgca

SEQ ID NO: 3532 - DNA, 50 bp; double-stranded, linear
ggtagancnctgtttagtactaggggcccctctcgggttaccaattcaga

SEQ ID NO: 3533 - DNA, 50 bp; double-stranded, linear
ctattatattttacagcatcattgatagttcgctctcccctgaagttttg

SEQ ID NO: 3534 - DNA, 52 bp; double-stranded, linear
cgtcaacgatgtaaagtaaagccttgtccagtttaatttacgagtggcgtaa

SEQ ID NO: 3535 - DNA, 400 bp; double-stranded, linear
ttaatccagaagtaccggtggatttagttattgaccactcagttcaagtggatagctatgcaaatccagaagctcttgaacgtaatatgaaattagaatttgaacgtaactatgaacgttatcagtttttaaattgggcaacgaaagcatttgataattacaatgcagttcctcctgcaactggaatagttcaccaagttaacttagaatatttagcaagtgttgtacatgttcgtgatgtagatggtgaaaaaactgcatttccagatacattagttggtactgattcacatacaacaatgataaatggtattggcgtactaggatggggtgttggtggtattgaagctgaagctggaatgcttggacaaccttcttatttcccaattccagaggttat

SEQ ID NO: 3536 - DNA, 1118 bp; double-stranded, linear
cgtatagagtgtcctacaaccccaacaagcaagcttgttggtttgggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacactagcgattatttcttatgaattcaagcttatttaaaactctttattcactcggttttgcttggtaaaatctatattttacttacttatctagttttcaatgtacaatttctttttagtcaagcgctcgcatactgctttattttcaaaaaatcaaatgctcatttacaaaagtaaactccgctttaatttttcttaatgcattgtctaacaaccgctttctttaaaaagaatagattgtcaagcgctcgcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactagcgttccagcttcatgtagtcgagtgcagactaccatccggactgnggaccaact

SEQ ID NO: 3537 - DNA, 424 bp; double-stranded, linear
ggggatccccagccagaagatttattcagtgcgatgattcgtgaaattgaaacgcaagatttcgatatcgaacacctggcgacggcaattcgtaamgttgaaacatcaacattaggtgaagaaagtgaaaatgactttatcggtctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaattgggcgctttgngcgacacgggtaaaaaaagcaggcgagttctatacaccacaacaagtatctaagatactggcgangattgtcacagacggtaaagataaattacgtcacgtgtatgaccc

SEQ ID NO: 3538 - DNA, 400 bp; double-stranded, linear
atctcatatgttaaaaggtaaacaaggtcgtttccgtcaaaacttacttggtaaacgtgttgactattcaggacgttcagttattgcagtaggtccaagcttgaaaatgtaccaatgtggtttaccaaaagaaatggcacttgaactatttaaaccattcgtaatgaaagaattagttcaacgtgaaattgcaactaacattaaaaatgcgaagagtaaaatcgaacgtatggatgatgaagtttgggacgtattggaagaagtaattagagaacatcctgtattacttaaccgtgcaccaacacttcatagacttggtattcaagcatttgaaccaactttagttgaaaggtcgtgcgattcgtctacatccacttgtaacaacagcttataacgctga

SEQ ID NO: 3539 - DNA, 1171 bp; double-stranded, linear
aataagtaagttattttgtctggtgactatagcaaggaggtcacacctgttcccatgccgaacacagaagttaagctccttagcgtcgatggtagtcgaacttacgttccgctagagtagaacgttgccaggcaaatgacaaatcggagaattagctcagctgggagagcatctgccttacaagcagagggtcggcggttcgaacccgtcattctccaccatttattcttagatatagccggcctagctcaattggtagagcaactgacttgtaatcagtaggttgggggttcaagtcctctggccggcaccatcttttgagccattagctcagctggtagagcatctgacttttaatcagagggtcagaggttcgaatcctctatggctcattacgatttaatttttatatttagcaaaataatgcagaagtagttcagcggtagaatacaaccttgccaaggttggggtcgcgggttcgaatcccgtcttctgctccattattttgccggggtggcggaactggcagacgcacaggacttaaaatcctgcggtgagagatcaccgtaccggttcgattccggtcctcggcaccattttagcgcccgtagctcaattggatagagcgtttgactacggatcaagaggttatgggttcgactcctatcgggcgcgccatttttaaattaattgaataacgggaagtagctcagcttggtagagcacttggtttgggaccaaggggtcgcaggttcgaatcctgtcttcccgattacttcttaaattccattttatgggggcttagctcagctgggagagcgcctgctttgcacgcaggaggtcagcggttcgatcccgctagtctccaccatttattttttacacgatgaacattgaaaactgaatgacaatatgtcaacgttaattccaaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtgggataacctacctataagactgggataacttcgggaaaccggagctaataccgg

SEQ ID NO: 3540 - DNA, 601 bp; double-stranded, linear
ctcggcagtgtgaaatcaacgactcgaagacacaatgtcttctccccatcacagctcagccttaacgagtaccggatttgcctaatactcagccttactgcttagacgtgcaatccaatcgcacgcttcgcctatcctactgcgtccccccatcgattaaaacgattataggtggtacaggaatatcaacctgttatccatcgcctacgcctgtcggcctcagcttaggacccgactaacccagagcggacgagccttcctctggaaaccttagtcaatcggtggacgggattctcacccgtctttcgctactcacaccggcattctcacttctaagcgctccacatgtccttacgatcatgcttcaacgcccttagaacgctctcctaccattgtccaaaggcatwcrcacagcttcggtaatatgtttagccccggtacattttcggcgcagtgtcactcgactagtgagctattacgcactctttaaatgatggctgcttctnagccaacatcctaggttggtctggggcacgcnacatccttttccacttaacatatattttggggaccttggctggtgggtctggggctgnttccc

SEQ ID NO: 3541 - DNA, 1311 bp; double-stranded, linear
gcnaggaccttnccaaatttgaaatcctttgaccacntttggggtagagccctttcccncggggacaaagtgaccaggtggtgcatggttgtcgtcagctcgtgtcgtgagatgttgggttaagtccccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgtgagntcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaaggatatattcggaacatcttcttcagaagatgcggaataacgtgacatattgtattcagttttgaatgtttgttcattcaaattaatgggcctatagctcagctggttagagcgcacgcctgataagcgtgaggtcggtggttcgagtccacttaggcccaccattaatttaatacctatttgggggcttagctcagctgggagagcgcctgctttgcacgcaggaggtcagcggttcgatcccgctagtctccaccattatttgtacattgaaaactagataagtaagtaaaatatagattttaccaagcaaaaccgagtgaataaagagttttaaataagcttgaattcataagaaataatcgctagtgttcgaaagaacactcacaagattaataacgcgtttaaatctttttataaaagaacgtaacttcatgttaacgtttgacttataaaaatggtggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggaggaagagaaagaaaattcgattcccttagtagcggcgagcgaaatgg

SEQ ID NO: 3542 - DNA, 400 bp; double-stranded, linear
ttcccatgccgaacacagaagttaagctccttagcgtcgatggtagtcgaacttacgttccgctagagtagaacgttgccaggcaaatgacaaatcggagaattagctcagctgggagagcatctgccttacaagcagagggtcggcggttcgaacccgtcattctccaccatttattcttagatatagccggcctagctcaattggtagagcaactgacttgtaatcagtaggttgggggttcaagtcctctggccggcaccatcttttgagccattagctcagctggtagagcatctgacttttaatcagagggtcagaggttcgaatcctctatggctcattacgatttaatttttatatttagcaaaataatgcagaagtagttcagcggtagaat

SEQ ID NO: 3543 - DNA, 804 bp; double-stranded, linear
gtgagagtgacgttatgttatgtaaataacagttaattataccggtggtcggggtcgaaccgcactccacaagtggaagagattttgagtcccgcgcgtctgccaattccgccacaccggcttaatggtaaacaaaaaacttccctttggaagcaattatggagcggaagataggatttacacctatacctcgttccgggaaggaactggttctaaaagttgaactactcccgcaaatattaaattatggagcggaagataggatttacacctatacctcattccaggaaggaatgtattctaagagttgaaatactcccgcattattattaaattatggagcggaagataggatttgcacctatacctcgttccgggaaggacktgtttctaaaagttgaactactcccgcataaacctggaggcggcaaccggatttgaaccggtgataaaggttttgcagacctctgccttaccacttggctatgcgccaataactgggctagctggattcgaaccaacgagtgacggatmaaagtccgttgccttaccgcttggctatagcccattaataataagggcggctgaaggggatcgaaccctcgaatgtcggaaccacaatccgatgtgttaaccacttcaccacagccgccatggcaggggcagtaggaatcgaacccacaccaaagttttggagacctctattctaccgttgaactatgcccctattaaaaataataatkggaggggggcagattcgaantgccgaacccgaaggagcgggatttacattccgccgggttt

SEQ ID NO: 3544 - DNA, 400 bp; double-stranded, linear
atgatgtcgttgcacaatcaattgataaattacattatagctttaatcgtttgaagtatagtttgaaaccagtagtcacagctgttcaaggtcgtgccttaggcggtggctgtgagcttgtactttactcacctattgttgtcgctgcaagtgaaacatatatcggtcttgttgaagcaggtgttggcttattaccgagtggcggtggccttgcagaaatggctgatcgcatattacgcacatcgcataagtttgatkacaaacaagcttccatgacaaaagtactgacgaatatcgcatttgcgaaagtctctacaaatgcctttgaggcacgtcgttatggttatttacgtggatacagatacgattattttcaatacagcacaacgtgtccgaagtt

SEQ ID NO: 3545 - DNA, 474 bp; double-stranded, linear
ccggcattctcacttctaagcgctccacatgtccttacgatcatgcttcaacgcccttagaacgctctcctaccattgtccaaaggnatcncacagcttcggtaatatgtttagccccggtacattttcggcgcagtgtcactcgactagtgagctattacgcactctttaaatgatggctgcttctaagccaacatcctagttgtctgggcaacgcacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtggctctacctccaataatcatcanttgaggctagccctaaagctaattcggagagaaccagtatctccagttcgattggaattctncg

SEQ ID NO: 3546 - DNA, 400 bp; double-stranded, linear
ttcagtgcgatgattcgtgaaattgaaacgcaagatttcgatatcgaacacctggcgacggcaattcgtaaagttgaaacatcaacattaggtgaagaaagtgaaaatgactttatcggtctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaattgggcgctttgngcgacacgggtaaaaaaagcaggcgagttctatacaccacaacaagtatctaagatactggcgagattgtcacagacggtaaagataantacgtcacgtgtatgacccaa

SEQ ID NO: 3547 - DNA, 400 bp; double-stranded, linear
aacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcggctcatcgcatccantttttgcctggc

SEQ ID NO: 3548 - DNA, 400 bp; double-stranded, linear
atgatgtcgttgcacaatcaattgataaattacattatagctttaatcgtttgaagtatagtttgaaaccagtagtcacagctgttcaaggtcgtgccttaggcggtggctgtgagcttgtactttactcacctattgttgtcgctgcaagtgaaacatatatcggtcttgttgaagcaggtgttggcttattaccgagtggcggtggccttgcagaaatggctgatcgcatattacgcacatcgcataagtttgatgacaaacaagcttccatgacaaaagtactgacgaatatcgcatttgcaaagtctctacaaatgcctttgaggcacgtcgttatggttatttacgtgatacagatacgattattttcaatacagcacaacgtgtccgaagttgg

SEQ ID NO: 3549 - DNA, 400 bp; double-stranded, linear
aggttactccaccggcttcgggtgttacaaactctcgtggtgtgacgggcggtgtgtacaagacccgggaacgtattcaccgtagcatgctgatctacgattactagcgattccagcttcatgtagtcgagttgcagactacaatccgaactgagaacaactttatgggatttgcttgacctcgcggtttcgctgccctttgtattgtccattgtagcacgtgtgtagcccaaatcataaggggcatgatgatttgacgtcatccccaccttcctccggtttgtcaccggcagtcaacttagagtgcccaacttaatgatggcaactaagcttaagggttgcgctcgttgcgggacttaacccaacatctcacgacacgagctgacgacaaccatgcacc

SEQ ID NO: 3550 - DNA, 400 bp; double-stranded, linear
cgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaacctgacggagcaacgccgcgtgagtgatgaaggtcttcggatcgtaaaactctgttattagggaagaacatatgtg

SEQ ID NO: 3551 - DNA, 506 bp; double-stranded, linear
acaaggtagccgtatcggaaggtgcggctggatcacctcctttctaaggatatattcggaacatcttcttcagaagatgcggaataacgtgacatattgtattcagttttgaatgtttatttaacattcaaatattttttggttaaagtgatattgcttatgcgagcgcttgacaatctattctttttaaagaaagcggttgttagacaatgcattaagaaaaattaaagcggagtttacttttgtaaatgagcatttgattttttgaaaataaagcagtatgcgagcgcttgactaaaaagaaattgtacattgaaaactagataagtaagtaaaatatagattttaccaagcaaaaccgagtgaataaagagttttaaataagcttgaattcataagaataatcgctagtgttcgaaagaacactcacaagattaataacgcgtttaaatctttttataaaaganaacgtttagcagacaatgagttaaattattttaaagcag

SEQ ID NO: 3552 - DNA, 2209 bp; double-stranded, linear
aagctgaggccgacagtggngcgatggataacaggttgatattcctgtaccacctataatcgttttaatcgatggggggacgcataggataggcgacgtgtcgattggattgcacgtctaagcagtaaggctgagtattaggcaaatccggtactcgttaaggctgagctgtgatggggagaagacattgtgtcttcgaggtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggagaaggggtgctctttagggttaacgcccagaagagccgcagtgaataggcccaagcgactgtttatcaaaaacacaggtctctgctaaaccgtaagtgantgtataggggctgacgcctgcccggtgctggaaggttaagaggagtggttagcttctgcgaactacgaatcgaagccccagtaaacggcggccgtaactataacggtcctaaggtagcgaaattccttgtcgggtaagttccgacccgcacgaaaggcgtaacgatttgggcactgtctcaacgagagactcggtgaaatcatagtacctgtgaagatgcaggttacccgcgacaggacggaaagaccccgtggagctttactgtagcctgatattgaaattcggcacagcttgtacaggataggtaggagcctttgaaacgtgagcgctacttacgtggaggcgctggtgggatactaccctagctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcagggtcgaaagacggacttagtgatccggtggttccgcatggaagggccatcgctcaacggataaaagctaccccggggataacaggcttatctcccccaagagttcacatcgacggggaggtttggcacctcgatgtcggctcatcgcatcctggggctgtagtcggtcccaagggttgggctgttcgcccattaaagcggtacrmggctgggttcagaacgtcgtgagacagttcggtccctatccgtcgtgggcgtaggaaatttgagaggagctgtccttagtacgagaggaccgggatggacatacctctggtgtaccagttgtcgtgccaacgcatnagctgggtagctatgtgtggacgggataagtgctgaaacatnctnaagcatgaagcccccctcaagatgagatttcccaacttcggttataagatccctcaaagatgatgaggttaataggttcgaggtggaagcatggtgacatgtgggagctgacgaatactaatcgatcgaagacttaatcaaaataaatgttttgcgacaaatncacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcagttttttaatcaaattttggttaaaaaataaaatggacaagataaaaaaagttattgacttaaatgttaataaaatgtataattaattcttgtcggtaagaaaaatgaacattgaaaactgaatgacaatatgtcaacgttaattccaaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggctttaccca

SEQ ID NO: 3553 - DNA, 518 bp; double-stranded, linear
ctagataagtaagtaaaatatagattttaccaagcaaaaccgagtgaataaagagttttaaataagcttgaattcataagaaataatcgctagtgttcgaaagaacactcacaagattaataacgcgtttcctgtaggatggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggaggaagagaaagaaaattcgattcccttagtagcggcgagcgaaacgggaagagcccaaaccaacaagcttgcttgttggggttgtaggacactctatacggagttacaaaggmcgacattrgacgaatcatctgggaaagwtgatccaaggaa

SEQ ID NO: 3554 - DNA, 587 bp; double-stranded, linear
agaatgacgggttcgaaccgccgaccctctgcttgtaaggcagatgctctcccagctgagctaattctccgatttaaaactgcctggcaacgttctactctagcggaacgtaagttsgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccaga

SEQ ID NO: 3555 - DNA, 399 bp; double-stranded, linear
gaatctgaatcgctatctgaatccgagtcactgtcggaatctgagtcactgtcggaatctgaatcgctatctgaatctgaatcgctgtctgaatctgaatcgctgtctgaatctgagtcgctatctgagtcggaatcgctatctgagtcggaatcactgtcggaatctgaatcgctgtctgagtcggaatcactgtcggagtcagaatcgctgtctgagtcggaatcactgtcggaatctgaatcgctatctgaatctgaatcgctatctgaatccgagtcactgtctgagtcagaatcgctatctggaatctggagtcactgtcggaatctgagtcactggtctggagtcagaatcgctatctggaatccgangtcatggtctgagtcgggaatcgct

SEQ ID NO: 3556 - DNA, 400 bp; double-stranded, linear
attcatctttccagatgattcgtctaatgtcgtcctttgtaactccgtatagagtgtcctacaaccccaacaagcaagcttgttggtttgggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgt

SEQ ID NO: 3557 - DNA, 657 bp; double-stranded, linear
cttagatgctttcagcacttatcccgtccacacatagctacccagctatgccgtnggacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcaancccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaactttgagcgcctccgttaccttttaggaggcgaccgccccagtcaaactgcccgcctgacactgtctaccmccacgataagtggtgcgggttmgmaagccaacacagctagggtagtatcccaccagcgcctncccactaatagcgctcacgtttcaaaggctcctacctatcctgtacaagctgtgccg

SEQ ID NO: 3558 - DNA, 400 bp; double-stranded, linear
gagtccatgggtgaaagaagcatctgcagcaactgtagcaggtattgctggaactaataatggtattactgttgcagcaggtactttcaaccctgctgatacaattcaagttgttgcaacgcaaggacagcggagagacagtgagtgatgagcaacgtatnntngatttcacagttgtcgcaccacaaccgaaccaagcgactactaagatttggcaaaatggtcatattgatatcacgcctaataatccatcaggacatttaattaatccaactcaagcaatggatattgcttacactgaaaaagtgggtaatggtgcagaacatagtaagacaattaatgttgttcgtggtcaaaataatcaatggacaattgcgaataagcctgactatgtaacgtt

SEQ ID NO: 3559 - DNA, 400 bp; double-stranded, linear
aaacgaatgcatacaatgtaacaacacatgcaaacggccaagtatcatacggagctcgtccgacacaaaacaagccaagcaaaacaaacgcatataacgtaacaacacatggaaacggccaagtatcatatggcgctcgccaacacaaaacaagccaagcaaaacaaatgcatacaacgtaacaacacatgcaaacggtcaagtgtcatacggagctcgcccgacatacaagaagccaagtaaaacaaatgcatacaatgtaacaacacatgcagatggtactgcgacatatgggcctagagtaacaaaataagtttgtaactctatccaaagacatacagtcaatacaaaacattacgtatctttacaacagtaatcatgcattctatgatgcttctaa

SEQ ID NO: 3560 - DNA, 485 bp; double-stranded, linear
tttaggttatacagcattgcaggcaggatacttatcaattacttatttaatcatggtgttattgatgattcgagttggtgaaaaattattacaaaaaatgggttctaagcgaccaatgttattaggtacattcattgtggtcattggtattgcacttatttcattagtattcttaccaggcatattttatgttatcagttgtgtcgtaggatatttatgtttcggactaggcttaggtatttatgcaacaccttctacagatacagctatttcgaatgcaccgttagataaagttggcgttgcttcaggtatttataaaatggcttcatcacttggtgggcgcattcggtgtcgcaattagtggtgctgtatatgctggtgcagttgctgcaacgagcattccatacaggtgcgatgattgcactttgggttaacgtattgaatggggaatccatggccatttatcgcaattttaatncgcgatt

SEQ ID NO: 3561 - DNA, 463 bp; double-stranded, linear
aaattatgtgaagtaaaaggagtacgtccatgcaaaatttagataagaattttcgacatttatctcgtaaagaaaagttacaacaattggttgataagcaatggttatcagaagaacaattcgacattttactgaatcatccattaatcgatgaagaagtagccaatagtttaattgaaaatgtcatcgcgcaaggtgcattacccgttggattattaccgaatatcattgtggacgataaggcatatgttgtacctatgatggtggaagagccttcagttgtcgctgcagctagttatggtgcaaagctagtgaatcagactggcggatttaaaacggtatcttctgaacgtattatgataggtcaaatcgtctttgatggcgttgacgatactgaaaaattatcagcagacattaaagctttagaaaagcaaattcataaaattgcggatgaggcatatcc

SEQ ID NO: 3562 - DNA, 643 bp; double-stranded, linear
aatttaaacccaattgtctggcaaaacgttttcctttataaaaagatttaaacgcgttaattaatcttggtgcnggtctttcgaacactagcgattatttcttatgaattcaagcttatttaaaactctttattcactcggttttgcttggtaaaatctatattttacttacttatctagttttcaatgtacaatttctttttagtcaagcgctcgcatactgctttattttcaaaaaatcaaatgctcatttacaaaagtaaactccgctttaatttttcttaatgcattgtctaacaaccgctttctttaaaaagaatagattgtcaagcgctcgcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgcctcg

SEQ ID NO: 3563 - DNA, 400 bp; double-stranded, linear
gataaatccaaatagtgcactataaaaaataatatctactaaagtatctttatgtaatcctgctttaactagtgcacgttgtaacaaagtaaccaagtaatattccgacagcaatgataattccataccatcgtacactcagtggtcctaagttaaatgccacaggatctatatagttaaatacaatacccattcaacctactcctcactcttatgactgttcttgataatttcttcatttaatctttcactaaattcttcggccgtgttaatgcccatgatatttaatcgatagttcattgcagcgacctcaataattaccgcaacatttctaccaggtcttacaggtattggttttttttagtggntttcagtatctaaaatacttagcgtctcttca

SEQ ID NO: 3564 - DNA, 400 bp; double-stranded, linear
tcgtcagcncntgtcgtgagacgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgangtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaacttttaggagctagc

SEQ ID NO: 3565 - DNA, 400 bp; double-stranded, linear
caaaccatttgtagctatttgtaactcttatattgatattgttcctggacatgttcacttgagagagcttgcagatatagctaaagaagcaattagagaagccggtgccattccatttgaattcaatacaattggtgttgatgatggaatagctatgggacatatcggaatgcgatattctctaccatcacgtgaaattattgcagatgcagctgaaactgtaattaacgctcattggtttgacggcgtattttacattcctaattgtgacaagattacacccggtatgattttagcagccatgaggacaaacgtaccagctatcttttgctctggtggaccaatgaaagctggcttatctgcacatggaaaagcattaacactttcatcaatgtttgaa

SEQ ID NO: 3566 - DNA, 420 bp; double-stranded, linear
aaattacgtacatatttaaagctgacggcactatgactgcaggaacatctgccccactttctgatggtgcaggatttgtagttttaatgtctggagataaagtgaaagaactcggcgtgacacctattgcacgattcgttggttttaaggcagtaggcgttgacccgaaaattatgggtattgggcctgcatatgcgattcctgaagtattgtcactcagcaatctatctgttgaagacattgatttgatcgaattgaacgaagcatttgcttctcaaacgattgcatctattaaagaagtaggtctagatatatcacgtacgaatgtgaatggtggcgctattgcttkaggtcatccattaggtgctacaggcgcaatgttaaccgcgcgtttacttaatgaaatgggtagacgtcccg

SEQ ID NO: 3567 - DNA, 400 bp; double-stranded, linear
tacgggaagtagctcagcttgggtagagcacttggtttgggaccaaggggtcgcaggttcgaatcctgtcttcccgatatactgtaattattatgggggcttagctcagctgggagagcgcctgctttgcacgcaggaggtcagcggttcgatcccgctagtctccaccatattatttacaaactatataaggcggtgtagctcagctggctagagcgtacggttcatacccgtgaggtcgggggttcgatcccctccaccgccactatttattagttgtaaaattatatttaggacctttagctcagttggttagagctaacggctcataaccgttcggtcgcaggttcgagtcctgcaggtcccatataattttggaggaatacccagtccggctgaa

SEQ ID NO: 3568 - DNA, 400 bp; double-stranded, linear
ttagccaatccccattctggacgtacctcactccaatcactcgcaaaccgctgcgcttcttccactggatgattcacacgaccaatcgttggcagtttgtccaaacgttcgcgattcggtgtttcagaaatcatcggcatcgcgtcattcaatgattcatatgcatctaaagcaatagaagataatgtgtctggcacatatacccatgccaacgtatcagtagacgtatgatgttctgctaccgcaaaaacagttgtctctggantatacacacctgattgttttaatccttgtctgacatttggacgattacatatcatcgctaataacttagcattnaaaaccgcttgatgcgccaccacaagccccacatttcaagtgatggcatggntgtgggttn

SEQ ID NO: 3569 - DNA, 400 bp; double-stranded, linear
ccccgacctcacgggtatgaaccgtacgctctagccagctgagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaccgcagattttaagtcc

SEQ ID NO: 3570 - DNA, 542 bp; double-stranded, linear
caaaacttccccgtcnatgtgaattcttgggggagattaggcctggttacccccgggttagtttttatccgttgagcgatggccntcccatggggacctaccggatcactaagtccgtcttttcgaccctgcttcgacttgtaggtctcgcagtcaagctcccttatgcctttacactctatgaatgatttccaaccattctgagggaacctttgagcgcctccgttaccttttaggaggcgaccgccccagtcaaactgcccgcctgacactgtctcccaccacgataagtggtgcgggttagaaagccaacacagctagggtagtatcccaccagcgcctccacgtaagytagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcg

SEQ ID NO: 3571 - DNA, 619 bp; double-stranded, linear
atgcccgaccacatggagcttccaatcccattgctctaaccaatgagctactgaaccataataaaaatgtaatgatggcggtctcgacgggaatcgaacccgcgatctcngcgtgacaggcaggcgtgttaacccctacactacgagacctataaaatattgcgggaggcggatttgaaccaccggacttcgggttatgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaaccgctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctkcgaccgaacggttatgagccgttagctctaac

SEQ ID NO: 3572 - DNA, 400 bp; double-stranded, linear
ggtgaagacatcacgtatcaagaagcatgggcagatgaagaatatcgtgaagacttaaaagcagaattaattgatcaagcggttacttcattgagccacaagatttattcagtgcgatgattcgtgaaattgaaacgcaagatttcgatatagaacatctagcgacggcgattcgcaaagttgaaacatctacattaggtgaagaaagtgaaaatgactttatcgggctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaatcgggcgctttgcggc

SEQ ID NO: 3573 - DNA, 400 bp; double-stranded, linear
caaatcgtaactcgccggttcattctacaaaaggcacgccatcacccattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaggatccactcaagagagacaacattttcgactacaggattattaccttctttgattcatctttccagatgattcgtctaatgtcgtcctttgtaactccgtatagagtgtcctacaaccccaacaagcaagcttgttggtttggggctcttcccatttcgctcgcggctactaa

SEQ ID NO: 3574 - DNA, 1051 bp; double-stranded, linear
tccctcaaagatggatgaggttaataggttcgaggtggaagcatggtgacatgtggcagctgacgaatactaatcgatcgaagacttaatcaaaataaatgttttgcgacaaatncnacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcataatattaatccacagtagctcagtggtagagctatcggctgttaaccgatcggtcgtaggttcgagtcctacctgtggagccatggctccttggtcaagcggttaagacaccgccctttcacggcggtaacacgggttcgagtcccgtagnagtcattattttggagaattagctcagctgggagagcatctgccttacaagcagagggtcggcggttcgaacccgtcattctccaccattttgattattaaattatatgaataagctggaggggtagcgaagtggctaaacgcggcggactgtaaatccgctccttcgggttcggcagttcgaatctgcccccctccaccatctatatattgggctatagccaagcggtaaggcaacggactttgactccgtcactcgttggttcgaatccagctagcccagccattagagccattagctcagttggtagagcatctgacttttaatcagagggtcagaggttcgaatcctctatggctcactacttgcactttccatttttgggaagtgcttttttttaggttctccaccaaatgtggtgggtatataatttaaagaactatttttaaaatacaacttttagagcttttattattaggcggccagtccattattgggcttggttgtcttctttttttctcctttgtacaagctgaaaatcatcattatacgtgcttaaagtgtgaaatttctgtaaccaaaagaatncacttgattaattnnatctatataatgcctc

SEQ ID NO: 3575 - DNA, 476 bp; double-stranded, linear
gtggagcgcttagaagtgagaatgcaagtgtgagtagcgaaagacgggtgagaatcccgtccaccgattgactaaggtttccagaggaaggctcgtccgctctgggttagtcgggtcctaagctgaggccgacacgtatggcgatggataacaggttgatattcctgtaccacctataatcgttttaatcgatggggggacgcataggataggcgacgtgscgattggattgcacgtctaagcagtaaggctgagtattaggcaaatccggtactcgttaaggctgagctgtgatggggagaagacattgtgtcttcgagtcgttgatttcacactgccgagaaaagcctctagatagaaaataggtgcccgtaccgcaaaaccgacacaggtagtccaagatgngaattctaangtgaancgagcgaactctcgttaaggaactcggccaaaatggaccccgtaaacttccggaa

SEQ ID NO: 3576 - DNA, 400 bp; double-stranded, linear
tttgttccttttttaatttatatatttaaaatacacatattcaagagctcgagatataagtcaatgtactaggcacacaatttaatattgacagtaattaaccgaacgaaaatgcgccccggggccccaacatagagaatttcgaaaagaaattctacagacaatgcaagttggcggggccccaacatagaagctggccaatagttagctttcaataatgtgcaagttggggtaagggccccaacacagaagctggccaatagtcagctttcaataatgtgcaagttggggtaagggccccaacacagagaatttcgaaaagaaattctacagacaatgcaagttggcggggccccaacacagaagctgggccaatagtcagcttttccaataatgtggc

SEQ ID NO: 3577 - DNA, 400 bp; double-stranded, linear
tgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtagcttcgcagaactaaccactcctcttaaccttccagcaccgggcaggcgtcagccctatacatcaccttacggtttagcagagacctgtgtttttgataaacagtcgcttgggcctattcactgcggctcttctgggcgttaaccctaaagagcaccccttctcccgaagttacggggtcattttgccgagttccttaacgagagttcgctcgctcaccttagaattctcatcttgactaac

SEQ ID NO: 3578 - DNA, 400 bp; double-stranded, linear
taacttaacacgacttcttaagtcatttagttttaatgtttgatgtgtttctgctaaaccaatctcccaaggaacaccggcatgctgaatactcgttttgggtgaagccctgtaccaccatcgtaaccactgatgacaattttatctgcaaatgcttttgccaccccagatgcaatggtaccaacacctgttttcgaaactaattttaccgcgatatctgcatctttattcgcatttttcaaatcatgtatcagttgcgctaaatcttctattgaataaatatcatgatgtggcggtggtgaaatcagaccgatacctggcgttggaccctcttgtcttcgcaatccacggatataccttagtaccaggtaattggaccaccttcaccaggctttgcacc

SEQ ID NO: 3579 - DNA, 400 bp; double-stranded, linear
agctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaccgcaggattttaagtcctgtgcgtctgccagttccgccaccccggcactataaaaat

SEQ ID NO: 3580 - DNA, 400 bp; double-stranded, linear
acgtaaataaccataacgacgtgcctcaaaggcatttgtagagactttcgcaaatgcgatattcgtcagtacttttgtcatggaagcttgtttgtcatcaaacttatgcgatgtgcgtaatatgcgatcagccatttctgcaaggccaccgccactcggtaataagccaacacctgcttcaacaagaccgatatatgtttcacttgcagcgacaacaataggtgagtaaagtacaagctcacagccaccgcctaaggcacgaccttgaacagctgtgactactggtttcaaactatacttcaaacgattaaagctataatgtaatttatcaattgattgtgcacgacatcatctacaagaccgtcttccatgcgcctttttccattaagaaagggttagc

SEQ ID NO: 3581 - DNA, 400 bp; double-stranded, linear
atgtcattgttggtacggcttttccagaaggattacaaggccaaaacattgcacgaacgattgcattgcgtgcggattatctgacacggtaccgggtcaaacagtgaatcgctactgctcatcaggattacaaaccatgcgattgcagccaatcaaattatggctggtcaaggagatatacttgtagctggtgcgttgaattgatgagtgccgtaccaatgggtggcaacgagcccacaaacaatccaaccttacaatatgatgatataggtgcgtcatatcctatgggtttaactgctgaaaatgtagcatcccaatttgacgtatcacgcgaagatcaagatgcttatgctgtcagaagtcatcaacgtgcctatgacgcacaacgtgatgggtccgg

SEQ ID NO: 3582 - DNA, 400 bp; double-stranded, linear
aactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggt

SEQ ID NO: 3583 - DNA, 400 bp; double-stranded, linear
aagcaggcgctctcccagctgagctaagcccccaaataggtattaaattaatggtgggcctaagtggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaaggttactccaccggcttcgggtgttacaaactctcgtggtgtgacgggcggtgtgtacaagacccgggaacgtatttcaccgtagc

SEQ ID NO: 3584 - DNA, 400 bp; double-stranded, linear
acttatttggcgatattttaagtgatgaagcttcagtgattcctggttcacttggtttatcaccttctgctagttttagtaacgatggtccaagattgtatgagcctattcatggatcagcaccagatattgcaggtaaaaacgttgccaatccatttggaatgattctatctttagcgatgtgtttacgtgaaagcttaaatcaaccagatgctgcagatgaattagaacaacatatttatagcatgattgaacatgggcaaacgacagcagatttaggcggcaaattgaatactactgatattttcgaaattctatctcaaaaattgaatcactaaggggggagatgtaaatggggtcaaacattatttgacaangtgtgggacagacatgtgttata

SEQ ID NO: 3585 - DNA, 400 bp; double-stranded, linear
actgatgacaattttatctgcaaatgcttttgccaccccagatgcaatggtaccaacacctgttttcgaaactaattttaccgcgatatctgcatctttattcgcatttttcaaatcatgtatcagttgcgctaaatcttctattgaataaatatcatgatgtggcggtggtgaaatcagaccgatacctggcgttgaccctcttgtcttcgcaatccacggatataccttagtaccaggtaattgaccaccttcaccaggctttgcaccttgcgcaactttaatttgaatttctttgggcatgttgtaaataatcactagttacaccaaaacgcccagaagcaacttgtttaatcgcacttactttggtggcttccatcaacttgtacttcataacggt

SEQ ID NO: 3586 - DNA, 400 bp; double-stranded, linear
tacaagtattaccattatctcnagaggattctagataaggggcatggatcatttgtcttcttatgaatttgagccagataaagaatctatcttaagtgtaatcttgacctcaatatgttgagagtttgatttacggaacaatattagacgcaaaagcaagtgagcatgcaacacgtatgactgcgatgaaaaatgccactgataatgcaactgaacttattgatgacttatcattagaatataacagagcgagacaagcagaaattacgcaacaaattactgaaattgttggtggttccgcagcgcttgaataatatttaanggaggaaaatagcatgggaattggccgtgtactcaagttatgggtcctgtaattgatgttcgatttgaacataacgag

SEQ ID NO: 3587 - DNA, 400 bp; double-stranded, linear
aagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaccgcaggattttaagtcctgtgcgtctgccagttccgccaccccggcactataaaaatggagcagaagacgggattcgaacccgcgaccccaaccttggcaaggttgtattctaccgctgaactacttctgcat

SEQ ID NO: 3588 - DNA, 400 bp; double-stranded, linear
tactattgacatgtgtgaaccctatgtccgattatttcgcgacctatttcctaatgcagctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggaataaatcttttaagggcttataaacgctcatctgacattgtagaattcatgctttcaaaagacgatatactacgacactcctacgaacttgtccagggattacgaaaagacctaagggtatgtaattgggcctaaatttattaatcgtttaaattccgtta

SEQ ID NO: 3589 - DNA, 400 bp; double-stranded, linear
agagcgaacggacgagaagcttgcttctctgatgttagcngcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagctgacggagcaacgncgcgtgagtgatgaaggtcttcggatcgtaaaactctgttattagggaagaacata

SEQ ID NO: 3590 - DNA, 509 bp; double-stranded, linear
gttaggagagcgttctaagggcgttgaagcatgatcgtaaggacatgtggagcgcttagaagtgagaatgccggtgtgagtagcgaaagacgggtgagaatccctccaccgattgactaaggtttccagaggaaggctcgtccgctctgggttagtcgggtcctaagctgaggccgacaggtaaggcgatggataacaggttgatattcctgtaccacctataatcgttttaatcgatggggggacgcataggataggcgaacgtgcgattggattgcacgtctaagcagtaaggctgagtattaggcaaatccggtactcgttaaggctgagctgtgatggggagaagacattgwgtcttcgagtcgttgatttcacactgccgagaaaagcctctagatagaaaataggtgcccgtaccgcaaaccgacacaggtaatccaagatgagaattctaaggtgagcgagcgaactctcgttaaggaactcggcaaaatgaccccgtaact

SEQ ID NO: 3591 - DNA, 400 bp; double-stranded, linear
atttcttatgaattcaagcttatttaaaactctttattcactcggttttgcttggtaaaatctatattttacttacttatctagttttcaatgtacaaataatggtggagactagcgggatcgaaccgctgacctcctgcgtgcaaagcaggcgctctcccagctgagctaagcccccaaataggtattaaattaatggtgggcctaagtggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggct

SEQ ID NO: 3592 - DNA, 440 bp; double-stranded, linear
tgggnaacgcaacatccttttccaacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttgaggctagccctaaagctatttcggagagaaccagctatctccaggttcgattggaatttctccgctaccctcagttcatccgctcacttttcaacgtaagtcggttcggtcctccattcagtgttacctgaacttcaacctgaccaagggtagatcacctggtttccgsgtstacgaccaaatastaaacgccctattcagactcgctttcgctanggctccacattactggn

SEQ ID NO: 3593 - DNA, 400 bp; double-stranded, linear
taaacgaaccaattttatttggtgcaccactagtattgaatcctgtgttctttattccatttgtattagcaccaattgttaacgtatggattttcaaacttttcgttgaagtgttaggaatgaatagttttagtgtgaatttaccttggacaacaccaggtccattgggcattatcatgggtacaggttttggtttatggtcattcgtactagctattactttgattgttgtagatattattatntactacccattcctaaaagtttatgatagtgaaattcttgatgaagaagaaggacgtaaagaaagtaattcagatttaaaagaaaaagttgcagcaaacctttgatacgaaaaaagctgattcaattttagcggcaagtggtgtatcagacgatg

SEQ ID NO: 3594 - DNA, 409 bp; double-stranded, linear
aagggaatcgaattttctttctcttcctccgggtactaagatgtttcagttctccgggtgtgccttctgatatgctatgtattcacatatcgataacatgacataactcatgctgggtttccccattcggaaatctctggatcaaagcttactacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcctctcgctc

SEQ ID NO: 3595 - DNA, 400 bp; double-stranded, linear
aatataagccctggatcatacatgacctgtatttgggcaatcccttctgctacatcttctgcccactcattcaatatttgttttgcaatatcatcaccttcttcagctgcttcaaacaatactggcacatgtgtgcttctcgtaaatcctccggcaatcatgcgctttttcaatgcactcgttgcagcacgttgctcaaacgttgtattttcagttggacgatacaataaatacccaacttcatttgccttatgaagctcaccattatcaatatgaccttggattattcttgtacgcacccccaatggcctggtaccaagcgtccatacaaaagatccgttctggcttggatattggatggtaatttccaattcggcctagttaatggcagcggttttaa

SEQ ID NO: 3596 - DNA, 596 bp; double-stranded, linear
tccgttgccttaccgcttggctatagccaatatatagatggtggaggggggcaattcgaactgccgaacccgaagagcggatttacagtccgccgcgtttagccacttcgctaccctccagcttattcatataatttaataatcaaaatggtggagaatgacgggttcgaccgccgaccctctgcttgtaaggcagatgctctcccagctgagctaattctccaaaataatgactcctacgggactcgaacccgtgttaccgccgtgaaagggcgtgtcttaaccgcttgaccaaggagccatggctccacaggtaggactcgaacctacgaccgatcggttaacagccgatagctctaccactgagctactgtggattaatattatgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgatt

SEQ ID NO: 3597 - DNA, 400 bp; double-stranded, linear
tcatcttgaggggggcttcatgcttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcaataaagtc

SEQ ID NO: 3598 - DNA, 397 bp; double-stranded, linear
aaccaacggcagcaactacatgacctaattcttgtgctgactctacatttagtagctctaatgaagctttacaattggtaatacttttgtaccaccgccaacgattgccaatgtcataggcacttcaattgtaccaatcaatcgttgacgatcttgatcgtaacgccatgtagcaataccacgatactgtccgtcacgactcgcgtatgcatgcgcacttgcttctgcaccacgcgtatcatttcctgttgctaaaacaacagcatgtatgccattcataacacctttattatgtgttgctgcacgatgaatatctacttgggccaatacagaagcacgttccatcgtttgcaacctcttctccagttctctcgccccttggctaaatctttaacat

SEQ ID NO: 3599 - DNA, 400 bp; double-stranded, linear
aacccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaacctttgagcgcctccgttaccttttaggaggcgaccgccccagtcaaactgcccgcctgacactgtctcccaccacgataagtgtgcgggttagaaagccaacacagctagggtagtatcccaccagcgcctccaacgtaagc

SEQ ID NO: 3600 - DNA, 400 bp; double-stranded, linear
atctgaatctgagtcgttgtctgagtccgaatcgctatctgaatctgagtcgctatctgagtctgagtcgctatctgaatctgagtcgctgtctgaatctgaatcactgtctgagtctgagtcgctgtctgagtctgaatcgctgtcagaatctgagtcgctatctgagtctgaatctgaatcactgtctgagtccgaatcgctatctgaatctgaatcgctatctgagtctgagtcgctatccgaatctgagtcgctatctgagtctgagtcgctatccgagtctgaatcgctgtctgagtctgagtcgctgtctgaatctgaatcgctatctgagtctgagtcgctgtctggaatcgcggtctggaatctgantcgctaactgaaatctgagtcgcta

SEQ ID NO: 3601 - DNA, 400 bp; double-stranded, linear
atttaatacctatttgggggcttagctcagctgggagagcgcctgctttgcacgcaggaggtcagcggttcgatcccgctagtctccaccattatttgtacattgaaaactagataagtaagtaaaatatagattttaccaagcaaaaccgagtgaataaagagttttaaataagcttgaattcataagaaataatcgctagtgttcgaaagaacatccacaagattaataacgcgtttaaatctttttataaaagaacgtaacttcatgttaacgtttgacttataaaaatggtggaaacataggttaagttattaagggcgcacggtgggatgccttggcactagaagccgatgaagggncgttactaacgacgatatgctttggggagctgtaagta

SEQ ID NO: 3602 - DNA, 396 bp; double-stranded, linear
gctgtctgagtcggaatcactgtnggagtcagaatcgctgtctgagtcggaatcactgtcggaatctgaatcgctatctgaatctgaatcgctatctgaatccgagtcactgtctgagtcagaatcgntatctgaatctgagtcactgtcggaatctgagtcactgtctgagtcagaatcgctatctgaatccgagtcattgtctgagtcggaatcgctcgctgagtcggaatcgcttgctgaatctgaatcactcgctgagtctgaatcacttgctgaatctgaatcactcgctgaatctgaaccactatctgatgtaggaatcactacccgaatctgaancgctatctgaataagaatcgctgccagatctgaacctggggtcagaatctgaat

SEQ ID NO: 3603 - DNA, 529 bp; double-stranded, linear
tttcttatctgtaattttatcgtaagattttttcgcaatgagatttggatcgtntttgtccactacaatatctaatagttttactttaagtccagcattcacaaaaagtgctgccagttgagcgcccattgtgcctgcgccaagaacggttactttattaattgtcatagtgattcctccaatttagttgaggataagataaccattaagataattggaataacgttgctattttataaaattaattaagtatctttgacagtcatcttagcctcttatttaaggaaaaagctttatgcttaaaataagtcttttttagtgaaattaatgcatctcatataattatttgctatttatacgaaagcmgaatctccagtcaaagcgcgtccaattactaaggcattaatttcatgtgtaccttcgtacgtgtaaatcgcttctgcatcagagaagaaacgtgcaatatcataatcgtcagctagtatgccattaccacctgtaataccgcggcccatagctactntctcac

SEQ ID NO: 3604 - DNA, 399 bp; double-stranded, linear
cacaagataagcattgtagatgtggatgctttaactgggcaagcgattggtcgtcctaaaacaggtacatatgcgctatctgacctagtcggtttagatattgcagtgtctgtaattaaaggcatgcaacaagtacctgaagaaacaccttattttcatgatgtcaaaattgtaaatacgttgtttgacaatggcgcactcggacgtaaaacgaaacaaggattttacaaaaaggataaagaaactaaagctcgacttgtttacgatgttgaaaaacaagattatgtacctgtatcgcaaccacaattaccaattttaaatgaatttaataaagacttagtgcataaccttgataccatattccaatgcgcaagacgagcggggactatttttatgggg

SEQ ID NO: 3605 - DNA, 400 bp; double-stranded, linear
atcacttgaggctagccctaaagctatttcggagagaaccagctatctccaggttcgattggaatttctccgctaccctcagttcatccgctcacttttcaacgtaatcggttcggtcctccattcagtgttacctgaacttcaacctgaccaagggtagatcacctggtttcgggtctacgaccaaatactaaacgccctattcagactcgctttcgctacggctccacatttactgcttaaccttgcatcaaatcgtaactcgccggttcattctacaaaaggcacgccatcacccattaacgggctctggactacttgtaagcacacggtttcaggttctatttcactccccttccggggtggcttttcacctttccctcacggtaatgggttcact

SEQ ID NO: 3606 - DNA, 400 bp; double-stranded, linear
aaatcctgcggtgagtgatcactaacccggttcgattccggtcctcggcaccattttcaataaaaacatatgcgcccgtagctcaattggatagagcgtttgactacggatcaagaggttatgggttcgactcctatcgggcgcgttaattatacgggaagtagctcagcttggtagagcacttggtttgggaccaaggggtcgcaggttcgaatcctgtcttcccgatatactgtaattattatgggggcttagctcagctggggagagcgcctgctttgcacgcaggaggtcagcggttcgatcccgctagtctccaccatattatttacaaactatataaggcggtgtagctcagctggctagagcgtacggttcatacccgtgaggtcgggggttc

SEQ ID NO: 3607 - DNA, 400 bp; double-stranded, linear
gggtgtgcttctgatatgctatgtattcacatatcgataacatgacataactcatgctgggtttcccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatattttacttacttatctagtttncaatgtacaaataat

SEQ ID NO: 3608 - DNA, 400 bp; double-stranded, linear
tagttttcaatgtacaaataatggtggagactagcgggatcgaaccgctgacctcctgcgtgcaaanagccgctctcccagctgagctaagcccccaaataggtattaaattaatggtgggcctaagtggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgt

SEQ ID NO: 3609 - DNA, 400 bp; double-stranded, linear
agggcactcttactgggcgtgttaaattactaanttcaatcagcagaagaactaggacatggcgcttttaaaattattgaaacacatgcattaaaagatgtacaagcagtattgggttttcataatgacccatcgcgttcggtaggtacatttgcaatcaaaacaggggcaattacatcagcagtagatcgttttgagtttcatattaaaggcgtgggtggtcatgctgcaaaccagaacaatgcaacgatccagttattgtgttggcgcaattgattaatagtattcaatccatagttagtagaaatctatctgcgtttgatgaagcggtagtaacaattggacaaatatcatgtggtaatacttggaatgtcattgctgatcatgcgtatgtacaagg

SEQ ID NO: 3610 - DNA, 400 bp; double-stranded, linear
agggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaatgaatttaactcattgtctgctaaacgttttgcttttataaaaagatttaaacgcgttgattt

SEQ ID NO: 3611 - DNA, 400 bp; double-stranded, linear
gagctaggccggcaatatgtaagaataaatggtggagaatgacgggttcgaaccgccgaccctctgcttgtaaggcagatgctctcccagctgagctaattctccgatttaaaactgcctggcaacgttctactctagcggaantaagttgnactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttaat

SEQ ID NO: 3612 - DNA, 400 bp; double-stranded, linear
acccagctcgcgtaccgctttaatgggcgaacagcaatcccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaacctttgagngcctccgttaccttttaggaggcgaccgccccagtcaaactgcccgcctgacactgtctcccaccacgataagtgtncgggggttagaaagccaacac

SEQ ID NO: 3613 - DNA, 487 bp; double-stranded, linear
acttacagctccccaaagcatatcgtcgttagtaacgtccttcatcggcttctagtgcaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacactagcgattatttcttatgaattcaagcttatttaaaactctttattcactcggttttgcttggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacattca

SEQ ID NO: 3614 - DNA, 400 bp; double-stranded, linear
accgtacgctctagccagctgagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgntctaccaagctgagctacttcccgtataattaacgcgcccgataggagtcgaacccataacctcttgatccgtagtcaaacgctctatncaattgagctacgggcgcatatgtttttattgaaaatggtgccgaggaccggaatcgaaccggtacggtgatcactcaccgcagattttaagtcctgtgcgtctgcnagttccg

SEQ ID NO: 3615 - DNA, 400 bp; double-stranded, linear
tcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgtttaggcataaaaaaaagagac

SEQ ID NO: 3616 - DNA, 420 bp; double-stranded, linear
tngtgtctttcgaacactagcgattatttcttatgaattcaagcttatttaaaactctttattcactcggttttgcttggkaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatctnctgaagaagatgttccgaatatatccttagaaaggaggngatccagccgcaccttccgatacggctaccttgttacgacttcaccccaatcatttgtcccaccttcgacggctagctcctaaaaggttactccaccggcttcgggtgttacaaactctcgtnggtgtgacgggcggtgtgtacaag

SEQ ID NO: 3617 - DNA, 400 bp; double-stranded, linear
cactagcgattatttcttatgaattcaagcttatttaaaactctttattcactcggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcancccaatcatttgtcccaccttcgacggctagctcctaaaaggttactccaccggcttcgggtgttacaaactctcgtggtgtgacgggcggtgtgt

SEQ ID NO: 3618 - DNA, 400 bp; double-stranded, linear
gatatacgctatggctggagcagtgtggccaaatggcggaagacaaacgtttaatgcgatatacttagcgcaaaatattggtgtggctgtcggtgctgcaatgggcggctttgtcgcagaatttagctttaactatatctttttagccaatcttattatgtatgttgtgtttgcgcttgtccggttaacnaatttaatattgaaattaatgcgaaagttaaatatccaactcatttagatattactggtaaaaagaataaagcaagatttatttcattagtactaatttgtgcaatgtttgcaatttgttgggttgcatatattcaatggggagtctacaatcgcttcattttacacaatctattaatatttcaatgggcacaatatagtgttttatggg

SEQ ID NO: 3619 - DNA, 400 bp; double-stranded, linear
tcgcacgccttcgcctatcctactgcgtccccccatcgattaaaacgattataggtggtacaggnaatatcaacctgttatccatcgcctacgcctgtcggcctcagcttaggacccgactaacccagagcggacgagccttcctctggaaaccttagtcaatcggtggacgggattctcacccgtctttcgctactcacaccggcattctcacttctaagcgctccacatgtccttacgatcatgcttcaacgcccttagaacgctctcctaccattgtccaaaggaaatccacagcttcggtaatatgtttagccccggtacattttcggcgcagtgtcactcgactagtgagctattacgcactctttaaatgatggctgcttctaagccaacatcc

SEQ ID NO: 3620 - DNA, 400 bp; double-stranded, linear
ttaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagncccaaggatgcgatgagccgacatcgaggtgcc

SEQ ID NO: 3621 - DNA, 475 bp; double-stranded, linear
ccacacccgcaaatggtgagccatagcaggattcggaacctctgcaccctctgattaaaagtcagcatgctctaccaactgagctaatggctcttccatggtgccggccagaggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatggaatgtaatttatacattcaaaactagatagtaagtaaaagtgattttgcttcgcaaaacatttattttgattaagt

SEQ ID NO: 3622 - DNA, 400 bp; double-stranded, linear
tggacgaaactttatatcgatcaatttctatcgagttggacaatgccgaagcgtgacaaaagtttttaccatgcatggttgcatttagcgcaacatgaccatagttttactaaagcacagcgcncaagtgattaaaggcttacccaatgatcctgaaatgacgatagagtcagtattaactcatttttcaatagatcaggaagactaccaagcttatgttgaaggacatcttttggcgttaccgggttgggcaggtatgttgtattaccgttcacaacagcatcactttgaacaacatttgttaacggattatttggcaattcggttagttgtcgaacaattgctagttggtggatgagttttaagtcagtcgctaaagattgtggaaagtaagatccgg

SEQ ID NO: 3623 - DNA, 400 bp; double-stranded, linear
tagatgctttcasacttatcccgtccacacatagctacccagctatgccgttggacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagccaacccttgggaccgactacagccccaggatgcgatgaccgacatcgaggtgccaaacctccccgtcgatgtgaactcttgggggagataagcctgttatccccggggtagcttttatccgttgagcgatggccttccatgcgggaacaccggatcactaagtccgtctttcgaccctgctcgactttgtaggn

SEQ ID NO: 3624 - DNA, 400 bp; double-stranded, linear
gagctaggccggcaatatgtaagaataaatggtggagaatgacgggttcgaaccgccgaccctctgcttgtaaggcagatgctctcccagctgagctaattctccgatttaaaactgcctggcaacgttctactctagcggaantaagtngnactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaacatttattttgattaagtcttcgatcgattagtattcgtcagctccacatgtcaccatgcttccacctcgaacctattaacctcatcatctttgaggggatcttata

SEQ ID NO: 3625 - DNA, 400 bp; double-stranded, linear
ttaaagaacgctaataactgatcgtaaccactatatatattgttgtgacctctaacagcataatgtctaaatgtttgtgggatatattgaagcaatccttttgctggattgccctgtaaaacgttgatgtctctaagcgaactagattgagttatacctgcatttcctcctgattcgtgttgaatcaagctaatgatatttcctacgtcagccgaagtaacattaacacccattcgttttgctgcacgacgtatatcgcctgcccaagcagatgcagccttattaacacctgaaccacttcgaacgccactacctttaagtgacttcaaccatttttctggatctttagctgtatcattccctggatgcgacccttgcatcanttgggaaatgtangtgt

SEQ ID NO: 3626 - DNA, 461 bp; double-stranded, linear
gattgtggttccgacattcgagggttcgatccccttcagccgcccttattattaatgggctatagccaagcggtaaggcaacggactttgactccgtcactcgttggttcgaatccagctagcccagttattggcggcatagcaagtggtaaggcagaggtctgcaaaacctttatcaccggttcaaatccggttgccgcctccaggtttatgcgggagtagttcaacttttagaacacgttccttcccggaagaggtataggtgcaaatcctatcttccgctccataatttaataataatgcgggagtatttcaactcttagaatacattccttcctggaatgaggtataggtgtaaatcctatcttccgctccataatttaatatttgcgggagtagttcaacttttagaaacagctccttcccggaaccgaggtataggtgtaaatcctatcttccgc

SEQ ID NO: 3627 - DNA, 400 bp; double-stranded, linear
tgcggtctcaatgcggctcatcgcatccattttttgcctggcaacgttctactctagcggaacgtaagttggctnanatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcggctcatcgcatccattttttgcctggcaacgttctactctagcggaacgtaagttcgactaccatcgacgctaagggagcttaacttctgtgtncgggcatggggg

SEQ ID NO: 3628 - DNA, 400 bp; double-stranded, linear
atgctttcagcacttatcccgtccacacatagctacccacctatgccgttggcacgacaactgggtacaccagaggtatgtccatcccggtcctctcgtactaaggacagctcctctcaaatttcctacgacccacgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagcctgttatccccggggtagcttttatccgntgagcgatgggccttccatgcggnaccaccggnttactaagtccgtctttcgancctgctcgacttgta

SEQ ID NO: 3629 - DNA, 400 bp; double-stranded, linear
tttataaatatcccagtctgaacgcgattcccataacggatcaatggcaggattgaaaggatgtacatatggatgcatatccgttgatgataaatcatgtttttcataccaagtcgctgccggcaaaacaatgtcagaatataacggtgttgccgtcattctgaagtctaaagagaccactaaatctaacttacctgttgtttcttcacgccacgtaatttcttctggcttttcatcttcatttggtgtagctaataaccctgattttgtgccaagtaaatgcttcataaagtattcttgaccttttgcagaacttgaaattaagtttgaacgccatataaataatgattttggatgattctntttcaaatcaggatcttctattgcaaatggggtttgt

SEQ ID NO: 3630 - DNA, 589 bp; double-stranded, linear
tttaagttgtngatttaaaatattaataaagtgtaaatttgactattganattckracaaatacatattaaaataatatttgttgaattaattgagttaggaaatttattttttagaaataaaataattaaaaataattcttgacttacaaaaacttacgagttataattaaatcttgtaagtgacaaacgaacattgaaaactgaatgacaatatgtcaacgttaattccaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggatratattttgaaccgcatggttcaaaagtgaaagacggtcttgctgtcacttatagatggatccgcgctgcattagctagttggtaaggtaacggcttaccaaggcaacgatgcata

SEQ ID NO: 3631 - DNA, 400 bp; double-stranded, linear
ccaactgagctaatggctcttccatggtgccggccagaggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgatttgcttcgcaaaacatttattttgattaagtc

SEQ ID NO: 3632 - DNA, 400 bp; double-stranded, linear
ccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatatnttacttacttatctagttttcaatgtacaaataatggtggagactagcgggatcgaaccgctgacctcctggcgtgcaaagcaggcgctctcccagctgagctaangcccccanataggtattaaattaatgggggggcctaagtggactcgaaccaccgacctca

SEQ ID NO: 3633 - DNA, 400 bp; double-stranded, linear
atatgtcaacgttaattccaaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcnacgatgcatagccgacctgaganggtgatcgg

SEQ ID NO: 3634 - DNA, 400 bp; double-stranded, linear
tgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatctta

SEQ ID NO: 3635 - DNA, 400 bp; double-stranded, linear
ttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaaatgcggctcatcgcatccattttttgcctggcaacgttctactctagcggaacgtaagttgggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagc

SEQ ID NO: 3636 - DNA, 400 bp; double-stranded, linear
tacttatctagttttcaatgtacaatttctttntagtcaagcgctcgcatactgattttcaaaaaatcaaatgctcatttacaaaagtaaactccgctttatttttcttaatgcattgtctaacaaccgctttctttaaaaagaatagattgtcaagcgctcgcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttncgatacggctaccttgttacgacttcaccccantcatttgtnccaccttcgacggctagctcctaaaaggttactccaccggcttcgggtgt

SEQ ID NO: 3637 - DNA, 400 bp; double-stranded, linear
agcgctcgcataagcaatatcactttaaccaaaaaatatttggaatgttaaataaacattcaaaactgnaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactagcgattccagcttcatgtagtcgagttgcagactacaatccgaactgagaaccacttatgggattgcctnac

SEQ ID NO: 3638 - DNA, 400 bp; double-stranded, linear
ttctccgatttaaaactgcctggcaacgttctactctagcggaagtaagtcganctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttggggaaatctcatcttgaggggggcttcatgcttagatgctttcagcacttatcccgtccacacatagctacccagctatgccgttggca

SEQ ID NO: 3639 - DNA, 551 bp; double-stranded, linear
atgtctctaacgcctttaatagtattgaacacaattgggaaaaaagcagcgataaaaataatcgcaatcgctggcaaactaccaataccaaaccatagaacaacaaatggtgcccatgctatcggagatatcggcctaatcaattgaaatagcggttcgatagcgttgtatagccaacgattccttccaagcaagaagcccaatggaatagcaaccaacaatgcgacaacaaagcccgctacaaatctccataaactaattgctaaatgttggaaaatttctccagtaacaatgaaagaccatatactttttcctacaagagcaggacccggtaacaatacaggttggtaatgcccaataataatgaccatttcccaaatgcctaagaaaataataaatgtgataataggtaatataaatttgttatttgtgggacgtgtcatgaacgcgatgcctccttatacaatgacggttcaacaaagtcatccatatgcaggtggattaaacaaatgatgttgttttaccangtcgtaatttcctgatagccggat

SEQ ID NO: 3640 - DNA, 400 bp; double-stranded, linear
cactaaactaaattaatgaagtgccttatgtataaaaattataacttgatccaacttacactaccaatagaaacttctgttagaattcctcaaattgatatttcgcgatatgttaatgaaattgttgaaacgatacctgatagcgaattcgataaattcagacatcatcgtggcgcaacatcctatcatccaaaaatgatgttaaaaatcaccttatatgcatatactcaatctgtattttctggtcgtagaatagagaaattacttcatgacagtattcgaatgatgtggttagctcaaaatcaaacaccttcttataaaactattaatcgtattagagtgaatcctaatactgatgcgttaattgaatctttatttatccagtttcatagtcaatgtt

SEQ ID NO: 3641 - DNA, 398 bp; double-stranded, linear
actagtcgagtgacactgcgccgaaaatgtaccggggctaaacatattaccgaagctgtggattgtcctttggcaatggtaggagagcgttctaagggcgttgaagcatgatcgtaaggacatgtggagcgcttagaagtgagaatgccggtgtgagtagcgaaagacgggtgagaatcccgtccaccgattgactaaggtttccagaggaaggctcgtccgctctgggttagtcgggtcctaagctgaggccgacagngtaggcgatggataacaggttgatattcctgtaccacctataatcgttttaatcgatggggggrcgcataggataggcgaacgttgcgattggattgcacgtctaagcagtaaggctggagtattaggcaaatccggta

SEQ ID NO: 3642 - DNA, 439 bp; double-stranded, linear
taatgtctacactttgcttgcgatcattcattttaaagccagactttttataatcttgtacaaatgcttgcgctacatccttgtgttgatcaagcaattcccctctcagtactagcacacagcaatacgcatcaggtataacgtcatcaccatgtttcaaagtcttacctttgcctaacttttcacccagtgcaccgaatggttcggctacagaataccctgtaattctgtgttcactcaatgcggctggcatttctgctggcgacatttcatgatagctaaaatgccccggtttaatctttaattgtttacgtaattcctcaagtaaaagataatgtgttgaataacgatgtggtataccaaaatggkaatcatcgccattattattaaattcatttaagtgcatacctttttgtcccataatgacattgccttcatg

SEQ ID NO: 3643 - DNA, 400 bp; double-stranded, linear
atttcttatgaattcaagcttatttaaaactctttattcactcggttttgcttggtaaaatctatattttacttacttatctagttttcaatgtacaaataatggtggagactagcgggatcgaaccgtgacctcctgcgtgcaaagcaggcgctctcccagctgagctaagcccccaaataggtattaaattaatggtgggcctaagtggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttncgatacggtta

SEQ ID NO: 3644 - DNA, 399 bp; double-stranded, linear
gcgaaactgtacggagcaacgccgcgtgagtgatgaaggtcttcggatcgtaaaactctgttattagggaagaacatatgtgtaagtaactgtgcacatcttgacggtacctaatcagaaagccacggctaacacgtgccagcagccgcggtaatacgtaggtggcaagcgttatccggaattattgggcgtaaagcgcgcgtaggngttttttaagtctgatgtgaaagcccacggntcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaacgtggggatca

SEQ ID NO: 3645 - DNA, 400 bp; double-stranded, linear
tattatactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaacgtaagtncgactaccatcgacgctaaggagcttaacttctgtgttcggcatgggaacaggtgtgacctccttgctatagtcaccagacatatgaatgtaaatnatacattcaaaactagatagtaagtaaaagtggattttgcttcgcaaaacatttattttggattaagtcttcgatcggattagtattcgtcagctccacatgtcaccatggcttccacctcg

SEQ ID NO: 3646 - DNA, 758 bp; double-stranded, linear
agataagtaagtaaaatatagattttaccaagcaaaaccgagtgaataaagagttttaaataagcttgaattcataaataatcgctagtgttcgaaagacacgancaagattaataacgcgtttaaatctttttataaaagaacgtaacttcatgttaacgtttgacttataaaaatggtggaaacatagattaagttattaagggcgcacggtggatgccttggcactagaagccratgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggagaagagaaagaaaattcgattcccttagtagcggcgagcanaacgggaagagcccaaaccaacaagcttgcttgggggtntgtaggacactctatacggattacaaaggacgacattagacgaatcatctggaaagatgaatcaaagaaggtaataatcctgtagtcgaaaatgttgtctctcttgagtggatcctgagtacgacggagcacgtgaaattccgtcggaatctggggaggaccatctcctaaggctaaatactctctagtgaccgatagtggaaccagtaccgtgagggaaaggtgaaaagcacccggaaggnagttgaaatagaactggaaaccgtgtgctta

SEQ ID NO: 3647 - DNA, 400 bp; double-stranded, linear
acaaactccgaatgccaattaatttaacttgggagtcagaacatgggtgataaggtccgtgttcgaaagggaaacagcccagaccaccagctaaggtcccaaaatatatgttaagtggaaaaggatgtggcgttgcccagacaactaggatgttggcttagaagcagccatcatttaaagagtgcgtaatagctcactagtcgagtgacactgcgccgaaaatgtaccggggctaaacatattaccgaagctgtggattgtcctttggnatgggtaaggagagcgttctaagggcgttgaagcatgatcgtaaggacatgtgggagcgcttagaagtgagaatgccggtgtgagtagcgaaagacgggtgagaatcccgtccaccgattgactaaaggtt

SEQ ID NO: 3648 - DNA, 521 bp; double-stranded, linear
gtcattggaaactggaaaacttgagtgcagaagaggaaagtggaattccatgtgtagcggtgaaatgcgcagagatatggaggaacaccagtggncgaaggcgactttctggtctgtaactgacgctgatgtgcgaaacgtggggatcaaacaggattagataccctggtagtccacgccgtaaacgatgagtgctaagtgttagggggtttccgccccttagtgctgcagctaacgcattaagcactccgcctggggagtacgaccgcaangttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaagtggtgcatggtgtcgtcaactcctgtcgttgagatgttggggtaantccccgcaangagcgcacccttaagccttagtttncatcattaagttgggcactc

SEQ ID NO: 3649 - DNA, 400 bp; double-stranded, linear
ccaaagttcatcttttacgaatgagaaataggtgttgcatattcaatggtctcatcttgtttataaaagccaccatctaaatcactaatccattgtggtaagtctccaagttcgtcttccatacgtgttttaacacgttcgtatcccattgcatcccataattggaatggaccaagtttccagttgaacccccagacaagcgcacggtctatgtctcggaaatcatcggtagctttaggtacattgatagcagagtaatagaaattattacgtaatgtctcccataaaaatagtcccgcttcgtcttgcgcattgaatatggtatcaakgttatgcactaagtctttattaaattcatttaaaattggtaattgtggttgcgatacaggtacataatctt

SEQ ID NO: 3650 - DNA, 400 bp; double-stranded, linear
gcgataataaaaaataatggcggaggaagagggattcgaacccccgcggnccgttaaggccctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaaccgctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctgcgaccgaacggttatggagccgttagctctaancaacttgagc

SEQ ID NO: 3651 - DNA, 400 bp; double-stranded, linear
tggcgctgtgctttagtaaaactatggtcatgttgcgctaaatgcaaccatgcatggtaaaaactttgctcacgcttcggcattgtccaactcgatagaaattgatcgatataaagtttcgtccatttaatcatttgacgattcacttgttcgctaagtggctcaccttgttcatctattattgcatcactcatcggacgtacatcatagtgatgatatgattcagccatatcacgttttgatttttctaatagtagatcagcaacaacatcaacatttgaatgattcatatatgatggcaggtacgtcttttaatgttttaatgttatcaatataaagatgatgtagtgttgcgggatatgtagtgangttcaagtaacatatcagtaacaagttgatt

SEQ ID NO: 3652 - DNA, 400 bp; double-stranded, linear
cattgtccaaaggacaatccacagcttcggtaatatgtttagccccggtacattttcggcgcagtgtcactcgactagtgagctattacgcactctttaaatgatggctgcttctaagccaacatcctagttgtctgggcaacgccacatccttttccacttaacatatattttgggaccttagctggtggtctgggctgtttccctttcgaacacggaccttatcacccatgttctgactcccaagttaaattaattggcattcggagtttgtctgaattcggtaacccgagaggggcccctcgtccaaacagtgctctacctccaataatcatcacttgagggctagccctaaagctaatttcggagagaaccagctatctccaggttcgatggaatt

SEQ ID NO: 3653 - DNA, 400 bp; double-stranded, linear
ggttcggtcctccattcagtgttacctgaacttcaacctgaccaagggtagatcacctggtttcgggtctacgaccaaatactaaacgccctattcagactcgctttcgctacggctccacatttactgcttaaccttgcatcaaatcgtaactcgncggttcattctacaaaaggcacgccatcacccattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaagnatccactcaagagagacaacattttcgac

SEQ ID NO: 3654 - DNA, 400 bp; double-stranded, linear
aaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgntctatccaattgagctacgggcgcatatgtttttattgaaaat

SEQ ID NO: 3655 - DNA, 400 bp; double-stranded, linear
tattgaagcctgagtcaacacgtacgcaaatcgatcaaatcatcgatgaagcgaaacatacaattttaaatctgtatgtgtgaatccaacacatgttaaatatgcagcagagcnnctagctgattcagaggtgctcgtttgtacggtaataggattcccattaggtgcgtcgacaactgcaacgaaagcatttgaaacagaagatgcaattcaaaatggtgcagatgaaattgacatggtcatcaacatcggcgcattaaaagatggacgttttgatgatgtacaacaagacattgaagcagtggttaaagctgcgaaaggtcacacagtaaaagtggattattgagacggtattgttgggaccatgacgaaattgtaaaagcgagtggaattaaccaaa

SEQ ID NO: 3656 - DNA, 530 bp; double-stranded, linear
gatgagtcgctgnctgatctgaacgctgtctgagnccgaacgctactgaactgagtcgctgtctgagtctgaatcgctatctgaatctgagtcgctatctgagtctgagtcgctgtctgagtctgagtcgctgtctgagtctgaatcgctatctgaatctgagtcgctgtctgagtctgagtcgctatctgagtctgagtcgctgtctgaatctgagtcgctgtctgaatctgaatcgctgtctgagtctgaatcgctatctgagtctgaatcgctatctgagtctgaatcactgtctgagtccgagtcactgtctgaatctgactcactatctgattctgagtcgctatctgattctgagtcgctgtctgaatctgaatcactgtctgaatccgaatcgctatctgattctgagtcgctatctgaacctgagtcgctgtctgagcctgaagtcactggtctgaatccgaatccggatccgggtctggggcttgggttccggttctgggtctgggacttgggttctggga

SEQ ID NO: 3657 - DNA, 400 bp; double-stranded, linear
gttttaactacgcaagacatcgaagaagctgacggtgtcataattgcagctgataaacaagttgatctgtcccgatttgttggtaaacggttgattaatgaaaatgttcgcgaagggattcataatccgagaggtctaattcaacgtatcattaatcaagatgcgcctatttatcaatctgaaacaaattatcattcgaaagatcgcggtaagtctaaaaatggtattcaaatggtgtatcaacatttaatgaacggtgtatcgtttatggttccttttatcgtagttggtggactccttatcgccatcgcgctggactctaggcggtgaacgacatcaaaaggattagtcatcccagatggattcattttgggaaatccattggaaaacattgggtagt

SEQ ID NO: 3658 - DNA, 668 bp; double-stranded, linear
gaagaagtttatgaaacggttatgaataagccatacactagatatccagtgtacgagggagatattgataacattattggggtgtttcattctaaatatctgttggcttggagtaataaaaaagaaaatcaaattacaaactattcagctaagccattatttgtgaatgaacacaataaagctgaatgggtattacgtaagatgactatttctagaaaacatttagcaattgtgttggacgaatttggtggtactgaagcgatagtgtcacatgaagacttaattgaagaattattaggtatggaaattgaagatgagatggataaaaaggaaaaagaaaaactttctcaacagcaaattcmatttcaacaacggaaaaatcgcmacgtatctatataaggngcgaacagctatgtggtaataagaatcgacttactcaaatgttaagtattgaatatccaattatacaagcaggtatggcaggnagtacgacaccgaaattagttgcatcagtaagtaacagtggtgggttaggcacaataggcgcggttactttaatacgcagcaattggaagatgaaatagattatggtacgccaattaacgtcaaattcttttggcgtaaatgtctttggtaccaagtcaacaatcatataccagtagtcaaat

SEQ ID NO: 3659 - DNA, 400 bp; double-stranded, linear
aaaagaatggtaagttgaataaagtattgaaatcaattgccaatatctttataccgttgattcctgnatttattggagctggattaattggtggtattgcagcagtactgagtaacttaatggtggcaggctatatttcaggtgcttggattacgcaacttataacagtatttaatgtcattaaagacggtatgttagcatacttagctattttcactggtattaatgcggctaaagaatttggtgcgacaccaggacttggtggcgtgattggtggtacaacgttattaacgggtattgctggtaaaaatattttaatgaatgtcttcactggagaaccattgcaacctggacaangtgggattattggcgttattttgccgtttggaatttaagtaat

SEQ ID NO: 3660 - DNA, 400 bp; double-stranded, linear
ctgagctaatggctcttccatggtgccggccagaggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcggactaccatcgacgctaaggagcttaacttctgtgttcggcatgggaacaggtgtgacctccttgctatagtcaccagacatatgaatgtaatttatacattcaaaactagatagtaagtaaaagtgattttgntttcgcaaaacatttattttggattaagtc

SEQ ID NO: 3661 - DNA, 400 bp; double-stranded, linear
tgatgtttgattagctcataaatactaaataatgtttgtaacttatagttacgttttttggaattaacgttgacatattgtcattcagttttcaatgttcatttttcttaccgacaagaattaattatacattttattaacatttaagtcaataactttttttatcttgtccattttattttttaaccaaaatttgattaaaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcntcgcaaacatttattttgatta

SEQ ID NO: 3662 - DNA, 742 bp; double-stranded, linear
cgctcaacgtctgccttcgtaatggcttttgtagaaattctaactaaataatttcgaatgctatcattgattgtttcaacagcttgatgcttttgttcaagctttttgatcaattttttatcgtcttttgtaatttcgcgaatgtcttcaaacattgataagacaatctgacccacattttgtaattctttttgagtttcttgtaatgcaacaccaggtgcgtgataaacaagatctttgtttaagtgctgaggtttatagtcatcagcaatatctttacctgggacaagctttgtaacaatccatgctaaacctgctacaaatggtaattgaatcaaagtatttgttatgttgaagataccatgtgatactgcaatcgtcatcgctggttttaagtgccataaatcttgtaacaaactaatcaaatgaatcacaactggcaagaaaattgtgaagataattaccccgattaagttaaagatgacgtgtacaagcgccgcacgttttgcagcgattgagccggctaaactagctaagatagctgtaatcgtggtaccaatgttatcgcctagtaacacagggatkgctgcgtttaagctaattaaatcttgttgataaaattcttgtaaaataccaatcgtcgcacttgaactttgaactagtgctgttaaccctggcgccgacaatgacagcgagtattgggatttgtaagacatatcaagcattaaattggcttnaaatc

SEQ ID NO: 3663 - DNA, 400 bp; double-stranded, linear
atgaattcaagcttatttaaaactctttattcactcggttttgcttggtaaaatctatattttacttacttatctagttttcaatgtacaatttctttttagtcaagcgctcgcatactgctttattttcaaaaaatcaaatgctcatttacaaaagtaaactccgctttaatttttcttaatgcattgtctaacaaccgctttctttaaaaagaatagattgtcaagcgctcgcataagcaatatcactttaaccaaaaaatatttgaatgttaaataaacattcanaactgaatacaatatgtcacgtnattccgcatcttctgaagaagatgttccgaatatatccttagaaaggaggtgatccagccgcaccttccgatacgggctacctngtnac

SEQ ID NO: 3664 - DNA, 636 bp; double-stranded, linear
aactaatagttcacttttacttttttctttttcattattatccattattttttcaccgccaaaacgaatttcatgatgttaatttaaatgttctatgacaaaattaagcaacgatgttttatatttatttccaactatgtctagattaaatttctaaaaatakacatcatttaaaaggagcttgggacataaatcaatgtcctagggtctataatattataktgctagtagttgactgaatgaaaatgcgcttgcaacaagcttttttcaactctagtcaggggccccaacacagagaatttcgaaaagaaattctacaggcaatgcgagttggggtgtgggccccaacacagagaatttcgaaaagaaattctacaggcaatgcgagttggggtgtgggccccaacacagagaatttcgaaaagaaattctacaggcaatgcgagttggggtgtgggccccaacatagagaaatggattcccaatttctacagacaatgcaagttggcggggccccaacacagaagctgacgaaaagtcagcttacaataatgtgcaagttggcggggncccaacacagaagctgacgaaaagtcagcttacaataatgngcaagttggcggggnccccaacaca

SEQ ID NO: 3665 - DNA, 404 bp; double-stranded, linear
tatcatttcctgttgctaaaacaacagcatgtatgccattcataacacctttattatgtgttgctgcacgatgaatatctacttgggccaatacagaagcacgttccattcgtttggcaacctcttctccagttctctcgccccttgctaaatctttaacatcaatttcgccttgaactttaacaacggacgctgttgcatgattggataaaatactcattaaaatgtcgctttgggaaattcattttttaaaaatgcagttatggcctctaaaatcgtattaagcatattagcgcccatagcatctttcgtatcaacaaatacttttaaagatagtaactgttgctcaggraatgtakcmatcgctatacgttggtaaccaccaccacgcgctttaataggaa

SEQ ID NO: 3666 - DNA, 400 bp; double-stranded, linear
gtggttccagtagcaattattgaacgatattaggctatctagtcggcatatttgtaaaacaagatccaattaaatatcaacaggaataacgaataatataaaagaggttgggacataaatccctaaaaaaacagcagtaagataattttcaattagaaaatatcttactgctgttctctatttatacaatacttcgtattgaatggcttcgctttcctagggtgccgtctcagcctcggtcttcgactggcactgctccctcaggagtctcgccattaatactacgtattaacgtgtaattttactttgaaatactttaaaaaaataagacactttgcccaacttgcacataaatgtaaaattcaataaaataaatttctgtgttggatccctncgtata

SEQ ID NO: 3667 - DNA, 400 bp; double-stranded, linear
ccaacaaatctgtctgtcgcatcgcctttgtcgttccaaataaatatgtacaaacgaatccaccagcatacgcnccaagtaatcctgcaatataacctaaatacatattatctgagattaatggtaatagtgacacaccacttgggcctattgctttggcaccaatatgtccaattccacctattacagcgccaccaataccaccaccaatacaagcagttaagaaaggtcgacctaatggcaaagtcacaccatagattaatggttctccgatacctagggaaaccaactggcaatgcaccttttaaagtattacgtaatgttgtgttgcggtttacatcttacccaaagtgctaatgcgggcacctacttggtcccagcaccagccatcgctgcaatt

SEQ ID NO: 3668 - DNA, 400 bp; double-stranded, linear
actaagatgtttcagttctccgggtgtgccttctgatatgctatgtattcacatatcgataacatgacataactcatgactgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacactagcgattatttcttatgaattcaagcttatttaaaactctttattcactcggttttgcttggtaaaatctatattttacttacttatctagttttcaatgtacaatttctttttagtcaagcgctcgcataa

SEQ ID NO: 3669 - DNA, 400 bp; double-stranded, linear
gtagcctgatattgaaattcggcacagcttgtacaggataggtaggagcctttgaaacgtgagcgctacttactggnaggcgctggtgggatactaccctagctgtgttggctttctaacccgcaccacttatcgtggtgggagacagtgtcaggcgggcagtttgactggggcggtcgcctcctaaaaggtaacggaggcgctcaaaggttccctcagaatggttggaaatcattcatagagtgtaaaggcataagggagcttgactgcgagacctacaagtcgagcanggtcgaaagacggacttagtgatccggtggttccgcatggaagggccatcgctcaacggataaaagctaccccgggggataacaggcttatctcccccaagagttcacat

SEQ ID NO: 3670 - DNA, 400 bp; double-stranded, linear
atactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaacgtaagttcgactaccatcgacgctaaggagcttaacttctgtgttcggcatgggaacaggtgtgacctccttgctatagtcaccagacatatgaatgtaaattatacattcaaaactagatagtaagtaaaagtgattttgcttcgcaaaacatttattttgattaagtcttccgatcgattagtattccgtcagctccacatgtcaccatgcttccacctccgaacct

SEQ ID NO: 3671 - DNA, 400 bp; double-stranded, linear
cacccgaagatattgctcagacaaagtcatcatatacaggaaagtatttaaaagaagtacttgaacgagataaacaaaatactgaagataaataagattaaaagaagtgaaggatgttataaatttatccttcgcttctttttattaatttagtaatgaatagtagaaagaaaagatgcgtaaaaagaattatgttaagatagggtcaatctagagtagttaaacataaatcgaactgggagtggggacagaaatgataaagaatcactaatgatttattatgtagtggttctttgtccattagccacagctattgtgtacttaaaaataggaatgcatgagtgcaccnanaggnagaatactaatttccaaagaaaaagtattccttatgttggggccc

SEQ ID NO: 3672 - DNA, 461 bp; double-stranded, linear
tggacctgtaaaaggagactcgattgtagaaaaagaagagattccattcgagaaagaacgtaaatttaatcctgatttagcmccagggacagaaaaagtamcmagagaaggacaaaaaggtgagaagacaataacgacaccaacactaaaaaatccattaactggagtaattattagtaaaggtgaaccaaaagaagaaatcacaaaagatccgattaatgaattaacagaatacggaccagaaacgataacaccaggtcatcgagacgaatttgatccgaagttaccaacaggagagaaagaagaagttccaggtaaaccaggaattaagaatccagaaacaggagacgtagttagaccaccggtcgatagcgtaacaaaatatggacctgtaaaaggagactcgattgtagaaaaagaagagattccattcaaaacgtaaatttaatccggatttagca

SEQ ID NO: 3673 - DNA, 400 bp; double-stranded, linear
cttatgaattcaagcttatttaaaactctttattcactcggttttgcttggtaaaatctatattttacttacttatctagttttcaatgtacaaataatggtggagactagcgggatcgaaccgctgacctcctgcgtgcaaagcaggcgctctcccagctgagctaagcccccaaanaggtattaaattaatggggggcctaagtggactcgaaccaccgacctcacgcttatcaggcgtgcgctctaaccagctgagctataggcccattaatttgaatgaacaaacattcaaaactgaatacaatatgtcacgttattccgcatcttcngaagaagatgttccgaatatatccttagaaaggaggtgatccagccgcaccttccganacggctacct

SEQ ID NO: 3674 - DNA, 400 bp; double-stranded, linear
acatgaagacttaattgaagaattattaggtatggaaattgaagatgagatggataaaaaggaaaaagaaaaactttctcaacagcaaattcaatttcaacaacggaaaaatcgcaacgtatctatataaggagcgaacagctatgtgggaataagaatcgacttactcaaatgttaagtattgaatatccaattatacaagcaggtatggcaggaagtacgacaccgaaattagttgcatcagtaagtaaacagtggtgggttaggcacaataggcgcggttactttaatacgcgccaattggangatgganatngattatgtacgccattaacgtcaaattcttttggcgtaaatgtctttgtaccaagtcaacaatcatataccagtagtccaaatt

SEQ ID NO: 3675 - DNA, 400 bp; double-stranded, linear
agctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcctcgtcgttagtattcgtcagctccacatgtcaccatgcttccacctcggacctattaacctcatcaaccttgagggntcttataaa

SEQ ID NO: 3676 - DNA, 400 bp; double-stranded, linear
tggacaatggtaggagagcgttctaagggcgttgaagcatgatcgtaaggacatgtggagcgcttagaagtgagaatgccggtgtgagtagcgaaagacgggtgagaatcccgtccaccgattgactaagtttccagaggaaggctcgtccgctctgggttagtcgggtcctaagctgaggccgacagcgtaggcgatggataacagttgatattcctgtaccacctataatcgttttaatcgatggggggacgcataggatangcgaangtgcgattggattgcacgtctaagcagtaaggctgagtattaggcaaatccggtactcgttaaggctgagctgtgatngggagaagacattgagtcttcgagtcgttgatttcacactgccgagaaaagc

SEQ ID NO: 3677 - DNA, 400 bp; double-stranded, linear
aaagcgccacatggtgccaagtctggagttaatccagcaattgcttgttttaagctattatatttttcttctacttttgttttttctgcggcaatttgttggtcagtcgcatcaccattgttaataacattttgtgcatttgttgattctgtttgacccgcacgtttagcattttcatatgcttggattgatgattgtgtcataccatcagtagttactgatttattgatttcttcatcaagtttcgtcttagcagtttttaaagcactattatcagctaaaggtactaattggattaattgcttgcgttaatcgctcattgacacgatttacatttgttaacgcagattgcacttcttgtactgttcttaatgggcttttggaataatagcattagcgc

SEQ ID NO: 3678 - DNA, 648 bp; double-stranded, linear
acagtcaattgntctaccaattgagctaggccggttaagaaatggttccaggacagagtcgaatgccgacacatggagcttcaatccattgctctaaccaactgagctactgaaccataataaaaatgtaatgatggcggtctcgacgggaatcgaacccgcgatctcngcgtgacaggcaggcgtgttaaccgctacactacgagacctataaaatattgcgggaggcggatttgaaccaccgtacttcgggttatgagcccgacgagctaccgaactgctccatcccgcgataataaaaaataatggcggaggaagagggattcgaacccccgcggcccgttaaggcctgtcggttttcaagaccgatcccttcagccggacttgggtattcctccattattataggtaaatcgctattaattataaaattaaatggcggtctcgacgggaatcgaacccgcgatctctgcgtgacaggcaggcgtgttaaycgctacactacgagaccattagtaaaacggaggaagagggattcgaacccccgcgagccgttaagcccctgtcggttttcaagaccgatcccttcagccgggacttggggtattcctccaaaattatatgggaccttgcaggactcgaacctgc

SEQ ID NO: 3679 - DNA, 400 bp; double-stranded, linear
ctgatcccgttgtgcttcacacccgatagatagggatttacagataaattcaggtctcttccacgtcatatttggacccatcgaaaattcgggttctcaaatcatcgaacataacaaaagaagctaagcaacatgtaggccgttgtcacttaacttcttgtttttccgatgacagcttctatttagagaatgtcatgattattttatattcacttcaatgttatcaatattagtgccatctatgacatctgccatgcgattttcttgtaattttttgtgcaattcaaacgtgtactttccaccgtttttcattttaataacaattttacctgaaccaacgttaccgtacagattatttttttcaataagttgttttctcaatttaaaatcaagttctttc

SEQ ID NO: 3680 - DNA, 400 bp; double-stranded, linear
tcaatgcggctcatcgcattcatttcttgtctagcaacgttctactctagcggaantaagttagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaagtaagttggctaccatcgtcgctaaagacctttcttgacttgtgacaatcgcttggcttctntcctctccttcggntctcggcttactc

SEQ ID NO: 3681 - DNA, 400 bp; double-stranded, linear
tctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtggtttactttttattttgacggtttaggc

SEQ ID NO: 3682 - DNA, 414 bp; double-stranded, linear
ttgaacatgttgaatctaatgaaattcttgttcgtcgtctagttgaagagaacggcgttgagcatgaaggtgaattagatcgctatccattagctaaatttaaacgttcaaactcaggtacatgttacaaccaacgtccaatcgttgcagttggagatgttgttgagtataacgagattttagcagatggaccatctatggaattaggagaaatggcattaggtagaaacgtatagttggtttcatgacttgggacggttacaactatgaggatgccgttatcatgagtgaaagacttgtgaaagatgacgtgtatacttctattcatattgaagagtatgaatcagaagcacgtgatactaagttaggacctgargaaatcacaagagatattcctaatgtttctgaagtgca

SEQ ID NO: 3683 - DNA, 400 bp; double-stranded, linear
ttggaatttctccgctaccctcagttcatccgctcacttttcaacgtaagtcggttcggtcctccattcagtgttacctgaacttcaacctgaccaagggtagatcacctggtttcgggtctacgaccaaatactaaacgccctattcagactcgctttcgctacggctccacatttactgcttaaccttgcatcaaatcgtaactcgccggttcattctacaaaaggcacgccatcacccattaacgggctctgactacttgtaagcacacggtttcaggttctatttcactccccttccggggtgcttttcacctttccctcacggtactgggttcactatcggtcactangagagtatttaagccttangagatggtcctcccagattcccgacggg

SEQ ID NO: 3684 - DNA, 528 bp; double-stranded, linear
gatntatgatgaaaaactatctgactgctgtttcactttttataagacttctgaatgtcttcacttatacttctagtcacagattnaaataatcaaaagtgcacattattaaaatatcaatttcacactcaatgcggctcatcgcattcatttcttgtctagcaacgttctactctagcggaacgtaagttagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctgggcaacgttctactctagcggaacgtaagttggctaccatcgtcgctaaagacctttcttgacttgtgacaatcgcttgcttctntcctctccttcggctctcggttact

SEQ ID NO: 3685 - DNA, 400 bp; double-stranded, linear
aaattatggtcgattgcgaatgatttaagagggancatggatgcgagtgaattccgtaattacattttaggcttgattttctatcgcttcttatctgaaaaagccgaacaagaatatgcagatgccttgtcaggtgaagacatcacgtatcaagaagcatgggcagatgaagaatatcgtgaagacttaaaagcagaattaattgatcaagtcggttacttcattgagccacaagatttattcagtgcgatgattcgtgaaattgaaacgcaagatttcgatatagagcatctagcgacggcgattcgcaaagttgaaacatctacattaggtgangaaagtgaaaatgnctttatcgggctgttcagcgatatggatttgagttcaacgcggctaggta

SEQ ID NO: 3686 - DNA, 403 bp; double-stranded, linear
ttaaattattggtctatcggttcttggggtggccatggtatctgttcactcttcggtggtgcagttgcgacaactatgggttggagatggattttcatcttctcaattatcgttgccgtactttcaatgttactcatcaaagggacgcctgaaacgaaatcagaaattaccaatacacataaatttgacgttgcagggctaattgttctagtagttatgttgctaagtttaaacgttgtcattactaaaggtgcagcacttggttacacatcattatggttctttggtttgattgcaatcgtaattgtagcattctttattttcttaaatgttgagaaaaaagtagataatccacttattgattttaaattattgaaaataaaccatatacaggtgcaacggt

SEQ ID NO: 3687 - DNA, 449 bp; double-stranded, linear
tatgagcccgacgagctaccgaactgctccatcccgcgataataaaaaataatggcggaggaagagggattcgaacccccgcggcccgttaaggncctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaaccgctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctgcgaccgaacggtatgagccgtagcnctaaccactgggctaaagtcctaatataattt

SEQ ID NO: 3688 - DNA, 400 bp; double-stranded, linear
aaaacgtcgtaatatgcaaattgaaggtgccaaggttgttattcaaggtttcnataatgccggaagtttcttagctaaattcttatatgatttaggtgcaaaaattgtaggtatctctgatgcttacggtgcattacacgatccaaatggcttagatatagattatttattagaccgtcgagatagttttggtacggtaacaaatttatttgaagaaacaatctcaaataaagaattgtttgaattagattgtgacattttagtaccagcggctatttcaaaccaaattacagaagacaatgcacatgatattaaagctagtatcgttgttgaagctgctaatggacctacaacaccagaagcaacacgtattttaactgaacgtggtatattattagtt

SEQ ID NO: 3689 - DNA, 400 bp; double-stranded, linear
cacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactagcgattccagcttcatgtagtcgagttgcagactacaatccgaactgagaacnactttatggggaa

SEQ ID NO: 3690 - DNA, 553 bp; double-stranded, linear
gcngcgttttaggcccattcggttacccccnttccataaatggtgcccggccagaggacttgaaccccccaacttactgattacaagtcagttgctctaccaattgagctaggccggctaagaaatggttcaggacagagtcgaactgccgacacatggagcttcaatccattgctctaccaactgagctactgaaccataataaaaatgtaatgatggcggtctcgacgggaatcgaacccgcgatctctgcgtgacaggcaggcgtgttaaccgctacactacgagacctataaaatattgcgggaggcggatttgaaccaccgacttcgggttatgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtanatcgctattaattataanattaaaatggcggtctcgacgggaatcgaacccgcggatct

SEQ ID NO: 3691 - DNA, 400 bp; double-stranded, linear
tcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcggctcatcgcatccattttttgcctggcaacgttctactctagcggaacgtaagttcggactaccatcgacgctaagggagcttaactttctgtgttcgggcatggggaacagg

SEQ ID NO: 3692 - DNA, 410 bp; double-stranded, linear
tcgaatactgtcatgaagtaatttctctattctacgaccagaaaatacagattgagtatatgcatataagatgtttttaacatcatttttggatgataggatgttgcaccacgatgatgtctgaattcatcgaattcctatcaggtatcgtttcaacaatttcattaacatatcgcgaaatatcattttgagaattctaacgantttcctattggtagtgtaagttggggtcatgttataatttttatacataaggcacctctttaatttagtttagtagtatttattaaattatacgagggacccaacacagaaaattcattttattgaattttacatttatgtgmcaagttgggaaaaatgtcttattttttcaaagtatttaaaagtaaaattacatgttaatacgt

SEQ ID NO: 3693 - DNA, 425 bp; double-stranded, linear
acttcatataatttatgaaataaacctgtcaattttggattgattatgctttgtgattctttttatttctgcgtaataacgctaaacctaaaatgctaaataatccgccgaacaacatgccgttgtttgttgattcttctccacctgtttcagtagttcagatttcttagattgtgcttttttagttggtaccactgctttaaccttttcattgatttcaataacaggtgttactactttaccttgttccactggtttagaaggttttttaggttcttctttagcaggtggtattggtttaccaggttcagttggtacctctggcgttggcggtgttggtgtttccggctcgcttggtacttctggtgtcggtggtgttgggtgtttnccggcttcgcttggtacttctgggtgttcggtgggcg

SEQ ID NO: 3694 - DNA, 400 bp; double-stranded, linear
gcatcgttgccttggtaagccgttaccttaccaactagctaatgcagcgggagtccatctataagtgacagcaagaccgtctttcacttttgaaccatgcggttcaaatnattatccggtattagctacggtttcccgaagttatcccagtcttataggtaggttatccacgtgttactcacccgtccgccgctaacatcagagaagcaagcttctcgtcccgttcgctcgacttgcatgtattaggcacgccgccaggttccatcctgagccaggatcaaactctccataaaaattatgatgtttgattagctcataaatactaaataatgtttgtaacttatagttacgttttttgggaattaacgttggacatattgtcattccagttttcaatgtt

SEQ ID NO: 3695 - DNA, 400 bp; double-stranded, linear
acctaatatatagacaggttcatcacttaatgactttgcaagttcggcaatgtcctgtgcgtcgcgtttgacacgataatcactgtcagggtttgaagcggaatcagggagtggttcagttaactcgctttctccataatcacgacgatcaacggctacaacagtaaaatggtcttttaactgttctgcaagaggcagaaaaatgtctccggtaccgtttgcaccaggaataaagatgagcacgggtccttgtccgacttggtggtatcgtaatttagcgccttgtaattctaaagtttccatattcaatgacctccatttgttaattgttaggtgataaacctaataatttagcaccatttggtataacttaatttcnccttttccttcatcnggttaa

SEQ ID NO: 3696 - DNA, 400 bp; double-stranded, linear
ttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttgattaanctgtgagtgttct

SEQ ID NO: 3697 - DNA, 400 bp; double-stranded, linear
cactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactancgattccancttcatgtagtcgagttgcagactacaatccgaactgagaacaactttatgggatttgcttgacctcgcggtttcgctnccctt

SEQ ID NO: 3698 - DNA, 400 bp; double-stranded, linear
aagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacactagcgattatttcttatgaattcaagcttatttaaaactctttattcactcggttgtgcttggnaaaatctatattttacttacttatctaggtttcaat

SEQ ID NO: 3699 - DNA, 400 bp; double-stranded, linear
tttatggcatacacgcatcataatacagcccaacaccactaatggtgcagttgcaaatccaaattcttccgctccaagcgcacatgcgtacgctacatctttaccagttaataacttaccgtctgtttctaacttaacacgacttcttaagtcatttagttttaatgtttgatgtgtttctgctaaaccaatctcccaaggaacaccggcatgctgaatactcgttttgggtgaagcccctgtancaccatcgtaaccactgatgacaattttatctgcaaatgcttttgccaccccagatgcaatggtaccaacacctgttttcgaaactaattttaccgcgatatctgcatctttattcgcatttttcaaatcatgtatcagttgcgctaaatcttct

SEQ ID NO: 3700 - DNA, 400 bp; double-stranded, linear
cgacgtaccatcgacgctaaggagcttaactttcgtgtgttcggcatgggaacaggtgtgacctcctttgctatagtcaccagacatatgaatgtaatttatacattcaaaactagatagtaagtaaaagtnattttgcttcgcaaaacatttattttgattaagtcttcgatcgattagtattcgtcagctccacatgtcaccatgcttccacctcgaacctattaacctcatcatctttgagggatcttataaccgaagttgggaaatctcatctcncggggggcttcatgcttagatgctttcagcacttatcccgtccacacatagctacccagctatgccgttggcacgacaactggtacaccagaggtatgtccatcccggtcctctcgtacta

SEQ ID NO: 3701 - DNA, 400 bp; double-stranded, linear
aaccaagcccaataatggactggccgcctaataataaaagctctaaaagttgtattttaaaaatagttctttaaattatatacccaccacatttggtggagaacctaaaaaaaagcacttcccaaaaatggaaagtgcaagtagtgagccatagaggattcgaacctctgaccctctgattaaaagtcagatgctctaccaactgagctaatggctctaatggctgggctagctggattcgaaccaacgagtgacggagtcaaagtccgttgccttaccgcttggctatagcccaatatatagatggtggaggggggcagattcgaactgccgaacccgaagagcggntttacagtccgccgcgtttagccanttcgntacccctccagnttattcatat

SEQ ID NO: 3702 - DNA, 400 bp; double-stranded, linear
tttaagtcctgtgcgtctgccagttccgccaccccggcactataaaaatggagcagaagacgggattcgaacccgcgaccccaaccttggcaaggttgttattctaccgctgaactacttctgcatatgcgggtgaagggagtcgaacccccacgccgtaaggttagatcctaagtctagtgcgtctgccaattccgccacacccgcaaatggtgagccatagaggattcgaacctctggaccctctggattaaaagtcagatgctctaccaactgagctaatgggctcttccatggtgccggccagaggacttggaacccccaacctactggattacaagtcagttggctctaccaattgangctaaggccggcaatatgttaagnatnaatggtggag

SEQ ID NO: 3703 - DNA, 400 bp; double-stranded, linear
caactaataaatagtggcggtggaggggatcgaacccccgacctcacgggtatgaaccgtacgctctagccagctgagctacaccgccttatatagtttgtaaataatatggtggakactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataaacctcttgatccgtagtcaaacgctctatccaattgagctaacgggcgcatatgtttttaattgaaatggtgcccgaggaccggaatg

SEQ ID NO: 3704 - DNA, 400 bp; double-stranded, linear
ctaacgcctacgcgttacatgaaaaacggagaacaagcagaacaattattacgtcagcttatagaaaaagatgaagcactagctaagtatgtcatggtttgtgatgaaacagcttggtggtcatatatgggtcaagataatgatattttcaaagatcaattaggtcatctaactgttcagctaagaaagtatcccgaagtgctagccaaaaatgatacgcaacagctagtgtcaatggcagcactcgcggcaaatgatcgcactttatatcaaatgatttgtggaaaagataatatttctaaaaatgatgtcatgacgttatttgaagatatcgcgcaagtctttttaaaggtaacactatcatttatgcaatacggcgcattacccagagttgcatggt

SEQ ID NO: 3705 - DNA, 478 bp; double-stranded, linear
caacgcattaagtcactccgcctggggngtacgtccgtgaagttggaaactcaaaggaattgacggggacccgcacaagcggtggagcatgtggtttaattcgaagcaacgcgaagaaccttaccaaatcttgacatcctttgacaactctagagatagagctttccccttcgggggtacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttggggctacacacgtgctacaatggacaatacaaagggcagcgaaaccgtgagtcaagcaaatcccataaagttgttctcagttcggattgtagtctgcaactcgactacatgaagct

SEQ ID NO: 3706 - DNA, 400 bp; double-stranded, linear
atcttaagtctttggtgaaccgttttgtagaattaaataatattacagagccgctagcagtaacgatccaaacgaatttaccaccatcacgtggattaggatcgagtgcagctgtcgcgattgcttttgttcgtgcaagttatgattttttagggaaatcattaacgaaagaagaactcattgaaaaggctaattgggcagagcaaattgcacatggtaaaccaagtggtattgatacgcaaacgattgtatcaggcaaaccagtttggttccaaaaaggtcatgctgaaacgttgaaanctcaaagtttagacggctatatggttgttataganactggtgtgaaaggttcaccaagacaagcagtagaagatgttccataaactttggtgaggaccct

SEQ ID NO: 3707 - DNA, 400 bp; double-stranded, linear
gtcgaactgccgacacatggagcttcaatccattgctctaccaactgagctactgaaccataataaaaatgtaatnntggcggtctcgacgggaatcgaacccgcgatctcctgcgtgacaggcaggcgtgttaaccgctacactacgagacctataaaatattgcgggaggcggatttgaaccaccgaccttcgggttatgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtaaatcgctattaattataaaattaaatggcggtctcgacgggaat

SEQ ID NO: 3708 - DNA, 400 bp; double-stranded, linear
gttcgcccattaaagcggtaccangctgggttcagaacgtcgtgagcangttcggtccctatcnggggtgggcgtaggaaatttgagaggagctgtccttagtacgagaggaccgggatggacatacctctggtgtaccagttgtcgtgccaacggcatagctgggtagctatgtgtggacgggataagtgctgaaacatctaagcatgaagcccccctcaagatgagatttcccaacttcggttataagatccctcaaagatgatgaggttaataggttcgaggtggaagcatggtgacatgtggagctgacgaatactaatcgatcgaagacttaatcaaaataaatgttttgcgaacaaaatccacttttacttactatctagttttgaatgtataa

SEQ ID NO: 3709 - DNA, 424 bp; double-stranded, linear
aattttatgggccctttatggactttatattmcctaaaatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgcgacaaaaggttagtttgaaattrggagtggggcagaattgataaagaaccactaatgacgataaagattaaaaggaggacgttatgatgacgattaaagttggaatcattgggtgtggtggtattgcgaatggcaagcacatgccaagtttacaaaaagttgaaaatgttgaaatgatcgcatttgtgacgtggactttcgaaagcc

SEQ ID NO: 3710 - DNA, 559 bp; double-stranded, linear
agtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaccgcaggattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagctkagatcctgaagtctagtgcgtctgccaattccgccacacccgcaaatggtgagccatagaggattcgaacctctggaccctctggattgaaaagtncagatgctctgaccaactggagctaatggctcttcccatggtggccggccagaaggacttggaacccccaacctgatggatttacaattcagttggctctaaccaatttgagctaaggc

SEQ ID NO: 3711 - DNA, 400 bp; double-stranded, linear
aaccttttaggagctagccgtcgaaggtgggacaaatgattggggtgaagtcgtaacaaggtagccgtatcggaaggtgcggctggatcacctcctttctaaggatatattcggaacatcttcttcagaagatgcggaataacgtgacatattgtattcagttttgaatgtttgttcattcaaattaatgggcctatagctcagctggttagagcgcacgcctgataagcgtgaggtcggtggttcgagtccacttaggcccaccattaatttaatacctatttgggggcttagctcagctgggagagcgcctgctttgcacgcaggaggtcagcggttcgatcccgctagtctccaccattatttgtacatttgaaaactagataagtaagtaaaatat

SEQ ID NO: 3712 - DNA, 400 bp; double-stranded, linear
tagaatgaaccggcgagttacgatttgatgcaaggttaagcagtaaatgtggagccgtagcganntcatgtctgaatagggcgtttagtatttggtcgtagcctgaaaccnngtgatctacccttggtcaggttgaagttcaggtaacactgaatggaggaccgaaccgacttacgttgaaaagtgagcggatgaactgagggtagcggagaaattccaatcgaacctggaaatagctggttctctccgaaatagctttagggctagcctcaagtgatggattattggaggtagagcactgtttggacgaggggcccctctcgggttaccgaattcagacaaactccgaatgccaatttaatttaacttggggagtcagaacattgggtgataaggtccg

SEQ ID NO: 3713 - DNA, 400 bp; double-stranded, linear
tttttaagtctgatgtgaaagcccacggctcaaccgtgaagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaacgtggggatcanacaggattagatacccggtagtccacgccgtaaacgatgagtgctaaagtgttagggggtttccgccccttagtgctgcagtaaacgcattnaagcactccgnctggggagtacgnccgcaagttggaaacttcaaaggaattgacgggggacccgcacaagcgttgggagcatgtggtttaatttcgaagcaacggagaggaacctga

SEQ ID NO: 3714 - DNA, 425 bp; double-stranded, linear
aggtaggactcgaacctacgaccgatcggttaacagccgatagctctaccactgagctactgtggattaatattatgcctggcaacgttctactctagcggaacgtaantcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctcccatgtcaccatgcttccacctcgaacctattaacctcatcatctttgagggatcttataaccgaagttgggaaatctcatcttgaggggggcttcatgtcttagcatttcagtcacttatgcccg

SEQ ID NO: 3715 - DNA, 400 bp; double-stranded, linear
gtccctgctgttcctatcatataaatgatagattcaaatagatttgtaggtttgtcatgcccagttacaagttgcgttatcgtagacactaacattaatatgactggtaatgttgctgttaataaactcataccaaatcctggcatctcttgatccgtaaattctttttgtgcacctaacgctgaaatatcgccttctcgtgtatacgcagacggaatcattttttgtgcactttgttaaatataggccctgcaatgagtgtactggaatggcaataatcataccatacagtaatacatctccaacatttgcctttaattcttttgcgagactaccggtcctgggatgtggtggtaaaaagccatgtgtcactgataaagctgttaccatangtagtcct

SEQ ID NO: 3716 - DNA, 400 bp; double-stranded, linear
ttatgaattcaagcttatttaaaactctttattcactcggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggnttcgggtgttacaaactgttcgtggtgtgacggggcggtgtgttacaagacccggga

SEQ ID NO: 3717 - DNA, 400 bp; double-stranded, linear
aaaggacgacattagacgaatcatctggaaagataattcaaagaaggtaataatcctgtagtcgaaaatgttgtctctcttgagtggatcctggtacgacggagcacgtgaaattccgtcggaatctgggaggaccatctcctaaggctaaatactctctagtgaccgatagtgaaccagtaccgtgaggaaaggtgaaaagcaccccggaangagttgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcanaanntgttctgaatagggcgtttagtattttggtcgtagcccgagaacca

SEQ ID NO: 3718 - DNA, 400 bp; double-stranded, linear
taattcatctgcagcatctggttgatttaagctttcacgtaaacacatcgctaaagatagaatcattccaaatggattggcaacgtttttacctgcaatatctggtgctgatccatgaataggctcatacaatcttggaccatcgttactaaaactagcagaaggtgataaaccaagtgaaccaggaatcactgaagcttcatcacttaaaatatcgccaaataagttttcacatacgatgacgtcaaattgttttggnatttgtgattaaatgcatactacaagcatcaacaaataagtgatttactgttacttctgggatataattgacttacttccatttacgactttgcgccacaatttactagaagctaatacatttccttatcaacggatgtna

SEQ ID NO: 3719 - DNA, 400 bp; double-stranded, linear
atttaaaactgcctggcaacgttctactctagcggaantaagtngagctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagctacccagctagccgttggcacgacaangg

SEQ ID NO: 3720 - DNA, 400 bp; double-stranded, linear
cgttacaccttccaataaatttgctgttgctggataaggagaaatattgatatattgtcttaaattactataatgccaatttaagtctggatgatttgttaagacaccaataggattatcttttataaccacttcaccctctttaaatgaaacttcgactgtatgtccagttgcatcggaaacatgataatgcaatggcggaacttcaccgatgtcatttaaatatacagctacaacatgtatttgggatgcttgttgtttcatatcttcaatgcttgttgtatatcccaaaatccatgtcacaatttcattttgcgtaatattcatcgcgtccgctttgtgtgttggatccatatggaactataacctcgggaaatattgtggttgaaatgggcacgcc

SEQ ID NO: 3721 - DNA, 400 bp; double-stranded, linear
agtcagtttatagcgattgctggactgacagtacttgtgccattattgccaatttatatggcatcactacaaaatctatcagtcgtagaaatacagttgtngagtggtatagcgattgctgctccagctgtaacgacgatgatagcttcgccgatatgggggaagctaggtgataagatcagccgaaaatggatggtgttaagagcgttacttggtttggcggtatgcttatttttaatggcattgtgtacgacaccattacagtttgtacttgtggaggttattgcagggactatttggtggtgttgttgatgcatcaagtgcgtttgcgagtgcagaaggcgccactganagatcgtgggaaaggtattaggaagactgcaaattncagttcagcgca

SEQ ID NO: 3722 - DNA, 400 bp; double-stranded, linear
tctaaaagttgaactactcccgcataaacctggaggcggcaaccggatttgaaccggtgataaaggttttgcagacctctgccttaccacttggctatgccgccaataactgggctagctggattcgaaccaacgagtgacggataaagtccgttgccttaccgcttggctatagcccattaataataagggcggctgaaggggatcgaaccctcgaatgtcggaaccacaatccgatgtgttaaccacttcaccacagccgccatggcaggggcagtaggaatcgaacccacaccaaaggttttggagacctctattctaccnttgaactatgcccctattaaaatgataaatggaggggggcagattcgaactgccgaacccgaggggcggattttac

SEQ ID NO: 3723 - DNA, 400 bp; double-stranded, linear
catttcttagccggcctagctcaattggtagagcaactgacttgtaatcagtaggttgggggttcaagtcctctggccggcaccatttntggaggggtagcgaatggctaaacgcggcggactgtaaatccgctccttcgggttcggcagttcgaatctgcccccctccatttattatttttaataggggcatagttcaacggtagaatagaggtctccaaaacctttggtgtgggttcgattcctactgcccctgccatggcggctgtggtgaagtggttaacacatcggattgtggttccgacattcgagggttcgatccccttcagccgccttattattaatgggctatagccaagcggtaaggcaacggactttgactccgtcactcgttggttcg

SEQ ID NO: 3724 - DNA, 400 bp; double-stranded, linear
cactttagcaaatggtgacaaagtccgtattgctacaatttttgacttaatggcaagtcaatatggcgtgcgtcgttttgatcataaattagaatcaaaaggatacgacgatgcagaatcaaaatatacacctgcttggcaagaagccatttcaggcgtaaaacaaagtgttngtcattcaagtagcgaaagaatttgcgcaaaacgctatcgatactgaagggcgttcaatgattatcatgggtgcgggtattaaccattggtttaactcagatacgatttatcgttccaatcttaaacttagttatgttatgtggctgtcaggtgtgaatggtggcggttggggctcactatgtggggacaagaaaaatgtcgtccgattgaaggatggagtactgtc

SEQ ID NO: 3725 - DNA, 476 bp; double-stranded, linear
cgctatctgaatctgaatcgctatctgaatctgagtcgttgtctgagtccgaatcgctatctgaatctgagtcgctatctgagtctgagtcgctatctgaatctgagtcgctgtctgaatctgaatcactgtctgagtctgagtcgctgtctgagtctgaatcgctgtcagaatctgagtcgctatctgagtctgaatctgaatcactgtctgagtccgaatcgctatctgaatctgaatcgctatctgagtctgagtcsctatccgaatctgagtcgctatctgagtctgagtcgctatccgagtctgaatcgctgtctgagtctgagtcgctgtctgaatctgaatcgctatctgagtctgagtcgctgtckgaatgcgctgtctgaatctgagtcgctatgctgaatgctgagtncgctatgtgagtctgaatgcgctgtgcagaatctgagtgcgctcatctgatgtttctt

SEQ ID NO: 3726 - DNA, 400 bp; double-stranded, linear
atacgaccactgtttaatgcgtccattaaatctggccaattattgaatttaactaattctagtttatatttcggatgattgtattgtgataataattttttagtcatcatcaaattagctgaatgtgtaatcggcaaatatccaattttaatcacttgctgattttgggcatttttagaccgttctttagacgtcctttgccaatcacatcctgtaattataaagattccaatgatgacgattatgcttaaccttttcatcgtcactcactccttataaataatattcaggttcaacttgatgatgattcaatgcaangtttccataatttcattacgaatcttaagtaggtggctatcattacggactgcgtggatgtgangctgtaaattccatantg

SEQ ID NO: 3727 - DNA, 400 bp; double-stranded, linear
acgacggatagggaccgaactgtctcacgacgttctgaacccagctcgcgtaccgctttaatgggcgaacagcaaacccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaactttgagcgcctccgttnccttttaggaggcgaacggccccagttcaaactgcccgcctgaacactgtc

SEQ ID NO: 3728 - DNA, 400 bp; double-stranded, linear
ttgaaaagtcatatcaaagcgcacatgtttttaagcgtcgtcgaacacctatcgtgaaaggtgtgtcatttgagtgtccaatcggtgcgacgattgcgattatcggagaaagtggtagcggtaaatcgacgttgagtctattgatattaggtattgagaaaccggataaaggttgtgtaaccttaaatgatcaaccgatgcataagaagaaagtgagacgtcatcaaattggtgctgtatttcaagattatacgtcatcattacatccatttcagactgttagagaaatcttatttgaagtgatgtgtcaatgtgatggacaacctaaagaagttatggaagtccaagcaattacattgttggaagaagtcggtctatctaaggcatacatgggataaat

SEQ ID NO: 3729 - DNA, 400 bp; double-stranded, linear
atcgaacccccgacctcacgggtatgaaccgtacgctctagccagctgagctacaccgccttatatagtttgtaaataatatggtggagactagcgggatcgaaccgctgacctcctgcgtgcaaanagccgctctcccagctgagctaagcccccataataattacagtatatcgggaagacaggttcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccngtagtgaatcactcaccgcagatttta

SEQ ID NO: 3730 - DNA, 400 bp; double-stranded, linear
atctctggatcaaagcttacttacagctccccaaagcatatcgtcgttagtaacgtccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatattttacttacttatctagttttcaatgtacaaataatggtggagactagcgggatcgaaccgctgacctcctgcgtgcaaagcaggcgctctcccagctgagctaagccccc

SEQ ID NO: 3731 - DNA, 401 bp; double-stranded, linear
tgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaatgtcttcgatcgattagtattcgtcagctccacatgtcaccatgcttccacctcgaacctat

SEQ ID NO: 3732 - DNA, 397 bp; double-stranded, linear
cattattaacggctatggtttaactgaagcacctcttgtacttgttaatacaccggaaaattcaaaacgtaagccaatgagtattggtaaagcagtcatgttcgttgatgcacgtatccttgatgataacggtgaggaagtacctactggtgagattggcgaacttgcaattaaggctaaaaatgtcacgccaggatattggaataaaccagcagagactgccaaagcatttcatggtcgatatttattaactggtgacttagcgagatggacaacgatggcgatatatttattattgaccgcaaaaaagaattaatcataactggtggcgaaaatgtcttaccatccgagtcgaaatgcttactgagcatccactagtagaccggtgtgtggtcgt

SEQ ID NO: 3733 - DNA, 400 bp; double-stranded, linear
aagtaacaatcgttcaccgtcgtgatgagttacgtgcacagcgtattttacaagatagagcattcaaaaatgataaaatcgactttatttggagtcatactttgaaatcaattaatgaaaaagacggcaaagtgggttctgtgacattaacgtctacaaaagatggttcagaagaaacacacgaggctgatggtgtattcatctatattggtatgaaaccattaacagcgccatttaaagacttaggtattacaaatgatgttggttatattgtaacaaaagatgatatgacaacatcagtaccaggtatttttgcagcaggngatgttcgcgacaaaggttacgccaaattgtcactgccacggcgatggtagtatgccagcgcaagtgccacggaatg

SEQ ID NO: 3734 - DNA, 480 bp; double-stranded, linear
gccgtttactgtggcttcgattcgtagcttcgcagaagctaaccactcctcttaaccttccagcaccgggcaggcgtcagccctatacatcaccttacggtttagcagagacctgtgtttttgataaacagtcgcttgggcctattcactgcggctcttctgggcgttaaccctaaagagcaccccttctcccgaagttacggggtcattttgccgagttccttaacgagagttcgctcgctcaccttagaattctcatcttgactacctgtgtcggtttgcggtacgggcacctattttctatctagaggcttttctcggcagtgtgaaatcaacgactcgaagacacaatgtcttctccccatcacagtcagccttaacgrgtaccggatttgccttaatactcagcctttactgctttagacgtgcaatccaatcggcaacgcttcgcctaatcctaactggcggtccccccccnat

SEQ ID NO: 3735 - DNA, 400 bp; double-stranded, linear
cgatcccttcagccggacttgggtattcctccaaaattatatggaccttgcagactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctggacctcctgcgtgcaaacagncgctctcccagctgagctnaagcccccataataattacagtatatcgggaagacaggattcgaacctgcgaccccttggtccccaaaccaagtggtttnaccaagttgagcta

SEQ ID NO: 3736 - DNA, 400 bp; double-stranded, linear
tgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaaccgctacactacgagaccattagtaaaacggaggaagagggattcgaacccccgcgagccgttaagcccctgtcggttttcaagaccgattccttcagccggacttgggtantcntccaaaattatatggaccttgcaggactcgaactgcgancgaacgg

SEQ ID NO: 3737 - DNA, 400 bp; double-stranded, linear
taataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaccgcaggattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgta

SEQ ID NO: 3738 - DNA, 400 bp; double-stranded, linear
agaatgacgggttcgaaccgccgaccctctgcttgtaaggcagatgctctcccagctgagctaattctccgatttaaaactgcctggcaacgttctactctagcggaagtaatcgganctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaacatttattttgattaagtcttcgatcgattagtattcgtcagctccacatgtcaccatgcttccacctcgaacctattaacctcatcatctttgagggatcttataaccgaagttgggaaatctcatcttggaggggggctt

SEQ ID NO: 3739 - DNA, 400 bp; double-stranded, linear
gntggnaagaatatccaggtgtatacatcagttggcgcgctatagcaattctttgccgctcaccacccgacatattttccacttccgaacttaattgataatgtcccaaaccgacatctttaattaattgctntgcacgttttctatcaaatttatcattacgtgcaagtgatgggaatatcatgttatcttcaatcgtttcaccaaacaagtcactttgctgcatcaaataactgattcgttgacgcaattcttccgggtcataatcattatagggtttacctttaaaataaagttctccactagttggactaaacaaattacatatntgcttttgaaatgtacttttaccactacctgatggacctataatggcaatactctcgcctttatctacttt

SEQ ID NO: 3740 - DNA, 413 bp; double-stranded, linear
atcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaantaattggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgcttttna

SEQ ID NO: 3741 - DNA, 400 bp; double-stranded, linear
cttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagctgttatccccggggtagcttttatccgttgagcgatggcccttccatgcggaaccaccggatcantaagtccgtctntcgaccctgntggacttg

SEQ ID NO: 3742 - DNA, 400 bp; double-stranded, linear
gttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcagttttaaatcggagaattagctcagctggggagagcatctgccttacaagcagagggtcggcggttcgaacccgtcattctccaccatttattcttacatattgccggcctagctcaattggtagagcaactggacttgtaatcagtaggttgggggttcaagtcctctggccggcaccatgggaagagccattagctcagttggtagagcatctgacttttaaatcagagggttcagaggttncgaatccgcta

SEQ ID NO: 3743 - DNA, 400 bp; double-stranded, linear
tcgcaataaccgcatcaaatgtattgcctaaaaaggctggattttccaatgtgtcatcattacggatctcgaagttctcataacgcacatcatgtaataacatattcatgcgtgctaagttgtatgtagtattgttacgttcttgtccgaaataacgatacacttgcgtttctttaccaacacgtaacaacaatgaaccggaaccacatgttgggtcgtacacgtgacgtaatttatctttaccgtctgtgacaatcttcgccagtatcttagatacttgttgtggtgtatagaactcgcctgcttttttacccgctgtcgccgcaaagcgcccgattaggaattcatatgcatcacctaacatatcaatttccatggtcactgtgaacgaatgggtaag

SEQ ID NO: 3744 - DNA, 400 bp; double-stranded, linear
ctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgatttgcttcgcaaaacattatttgattaagtcctcgatcgatagtatcgtcagctccacatgtcaccatgcttccanctcgnacctatt

SEQ ID NO: 3745 - DNA, 386 bp; double-stranded, linear
cataagtaaactctgctttaaaataatttaactcattgtctgctaaacgttttcttttataaaaagatttaaacgcgttattaatcttgtgagtgttctttcgaacactagcgattatttcttatgaattcaagcttatttaaaactctttattcactcggttttgcttggtaaaatctatattttacttacttatctagttttcaatgtacaatttctttttagtcaagcgctcgcatactgctttattntcaaaaaatcaaatgctcatttacaaaagtaaactccgctttaattttcttaatgcattgtctaacaaccgcttgctttaaaaagaatagattgncaagcgctcgcataagcaatatcacttnaaccaaaaaata

SEQ ID NO: 3746 - DNA, 677 bp; double-stranded, linear
aaggtgaaaagcaccccggaaggatgttgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcakaacanggtctgaatagggcgtttagtatttggtcgtaccganaaccaggtgatctacccttggtcaggttgaagttcaggtaacactgaatggaggaccgaaccgacttacgttgaaaagtgagcggatgaactgagggtagcggagaaattccaatcgaacctggagatagctggttctctccgaaatagctttagggctagcctcaagtgatgattattggaggtagagcactgtttggacgaggggcccctctcgggttaccaattcagacaaactccgaatgccaattaatttaacttggggagtcagaacatgggtgataaggtccgtgttcgaaagggaaacagcccagaccaccagctaaggtcccaaaatatatgttaagtggaaaaggatgtggcgttgccagacaactgaggatgttggcttagaagcagccatcattttaaagagtgcgtaatagctcactagtcgaagtgacactgcgccgaaaatgtgaccgggcntaaacnat

SEQ ID NO: 3747 - DNA, 417 bp; double-stranded, linear
gtccaatgattcatatgctttattatcacggtattgcctttgaatcgcatgcacaaaatatgatgctcattcatgaaaatggttggcctacacgtattgccttaaaagatttccatgatggtgttcgttttaagcgtgacatttaagtgaagctgcttcacacctgacattaaagccaatgccagaagcacataaaaaagtgaatagtaattcatttattgaaacagatgacgaacgtttagtacgcgactttttacatgatgcatttttctttattaatatcgccgaaatcatcttatttattgaaaagcaatatggtatcgatgaggagctgcaatggcaatgggktaaaggcatcatcgaggcgtatccagragcatttccagagttkgaataactatccaaccattcggtttt

SEQ ID NO: 3748 - DNA, 400 bp; double-stranded, linear
atgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagc

SEQ ID NO: 3749 - DNA, 400 bp; double-stranded, linear
tcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtctcaatgcggctcatcgcatccattttttgcctggcaacgttctactctagcggaagtaagttgggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccattttttctttgtgtntactttttaattttga

SEQ ID NO: 3750 - DNA, 400 bp; double-stranded, linear
ataaaaaaaagagaccttgcggtctcaaatgcggctcatcgcatccattttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctgggcaacgttctactctagcggaantaanttgggctaccatcgacgctaagaacctttcttgga

SEQ ID NO: 3751 - DNA, 400 bp; double-stranded, linear
cactcaccgcagatntttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagctnagnattcctaagtctagtgcgtctgccaattccgccacacccgcaaatggtgagccatagaggattcgaacctctggaccctctgattaaaagtcagatgctctaccaactggagctaatggctctttccatggtgcccggccagaggacttggaacccccaacctactgattacaagtcagttgctctaaccaattgagctaagccgggcaatatgttan

SEQ ID NO: 3752 - DNA, 400 bp; double-stranded, linear
ttanananccgcgacattatagagccaatcactagcctatctcagaatcaccaacgaatccttcattattaaggaatctaggcatctttacggcgtggttctaatcgcatctttttcaatctaagtgcgtttgtgacaacacttactgaacttagtgccattgcagcaccagcaacccatggcgcaagtaagcccaatgcagctatagggataccggcaatattatagccgaatgcccaaaatagattttgacgaatattacgaatggttgctttacttgcataaatggctttaggaataagcatcaagtcgccaccaagaatagtaatatcagctgcttcaatgggcaacttctgttacctggtaccaatgggcgataccggatatcagcttttaacta

SEQ ID NO: 3753 - DNA, 400 bp; double-stranded, linear
ccttgcggtctcaatggcggctcatcgcatccattttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagtggctaccatcgacgctaagaacctttcttgactggtgacaancgcttg

SEQ ID NO: 3754 - DNA, 381 bp; double-stranded, linear
ctgagctaagcccccaaataggtattaaattaatggtgggcctaagtggactcgnaccaccgacctcacgcttatcaggcgtgcgctctaaccagctgagctataggcccattaatttgaatgancaaacattcaaaactgaatacaatatgtcacgttattccgcatcttctgaagaagatgttccgaatatatccttagaaaggangtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaaaacccgggaacgtattcaccgtagca

SEQ ID NO: 3755 - DNA, 400 bp; double-stranded, linear
agctccccaaagcatatcgtcgttagtaacgtccttcatcggcttctagtgccaaggcatccccgtgcgcccttaataacttaatctatgtttccaccatttttataagtcaaacgttaacatgaagttacgttcttttataaaaagatttaaacgcgttattaatcttgtgagtgttctttcgaacataggcgattatttcttatgaattcaagcttatttaaaactctttattcactcggttttgcttggtaaaaacnatattttacttacttatctagttttcaatgtacaatttctttttagtcaagcgctcgcatactgctttattttccataagcaatancactttaaccaaaaaatatttggaatgttnaaataaacatncaaaactgaatac

SEQ ID NO: 3756 - DNA, 400 bp; double-stranded, linear
ctactcacaccggcattctcacttctaagcgctccacatgtccttacgatcatgcttcaacgcccttagaacgctctcctaccattgtccaaaggcatgcgcacagcttcggtaatatgtttagccccggtacattttcggcgcatgtcactcgactagtgagctattacgcactctttaaatggatggctgcttctaagccaacatcctagttgtctgggcaacgccacatccttttccacttaacatatattttgggaccttagctggtggtctgggctgtttccggnggggnacacggaccttatcacccatgttctgactcccaagttaaattaattggcattcggatttgtctgaatcggtaacccgagagggcccntcgtccaaacagtgctct

SEQ ID NO: 3757 - DNA, 458 bp; double-stranded, linear
ggcagatgctctcccagctgagctaattctccgatttaaaactgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaartttgggaatctcatcttgagggggggctcatgcttagatgcttcagcacttatcccgtccacacatagctanccagctatgccgttngcacgacaactggtacaccagangtatgtccatccc

SEQ ID NO: 3758 - DNA, 400 bp; double-stranded, linear
agcgctcgcatactgctttattttcaaaaaatcaaatgctcatttacaaaagtaaactccgctttaatttttcttaatgcattgtctaacaaccgctttctttaaaaagaatagattgtcaagcgctcgcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtac

SEQ ID NO: 3759 - DNA, 400 bp; double-stranded, linear
gacttgggtattcctccaaaattatatggaccttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctgacctcctgcgtgcaaagcagccgctctcccagctgagctaagcccccataataattacagtatatcgggaagacaggattcgaacctgcgaccccttggtcccaaaccaagtgctctaccaagctgaagctactttcccgtataatta

SEQ ID NO: 3760 - DNA, 400 bp; double-stranded, linear
cacttaatgcccgtaccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcaancccttgggaccgactacagccccaggatgcgatgagccgacatcgaggtgccaaacctccccgtcgatgtgaactcttgggggagataagcctgttatccccggggtagcttttatncgttgagcgatggnccttncatgcggaacaccggatcactaagtccgtctttcgaccctgctcgacttgtaggtctcgcagt

SEQ ID NO: 3761 - DNA, 623 bp; double-stranded, linear
tatgtattttataatgtacagctcgttgantcntatttttccttatattaagtgccattaatacaaaacctagctctcgtttaactttatttattcctcgaactgacattcgagtgaacccaaaatagccttcataaatccaaaaacaggctctacatcaatttttctttgactatagatttttttcgtttctggttcagaaagcttttgattaatttggactttaaagtattcccaattataattcttcatgattttcttattggatttcgaatttggtttcatgcattgatgtctcaaagaacatgatgaacagtcatcacattcatatagtttgaagtctcgtttaaaaccatatctatcattacggtatgcatatcttttaaaacctattcttttgttattaggacatataaattcatcattaagttcgtcatatttccaattttaagtgttgaaaatgtcacttttaaactttctagttttatctttaataaacatgccatacgtaataagtggcgtnttattaaaatcatcgataatagccatatagttttgctcactaccataaccggcatcagctacaaatatactccggtaaataaccgagggattgttggaat

SEQ ID NO: 3762 - DNA, 718 bp; double-stranded, linear
attttaaaaatagttctttaaattatatacccaccacatttggtggagaacctaaaaaaaagcacttcccaaaaatggaaagtgcaagtagtgagccatagaggattcgaacctctgaccctctgattaaaagtcagatgctctaccaactgagctaatggctctaatggctgggcctagctggattcgaaccaacgagtgacggagtcaaagtccgttgccttaccgcttggctatagcccaatatatagatggtggaggggggcagattcgaactgccgaacccgaaggagcggatttacagtccgccgcgtttagccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcggtgtcttaaccgcttgaccaaggagccatggctccacaggtaggactcgaaccttacgaccgatcggtttaacagccgatagctcttaccactggagctactgtgggattaatattatgcctgggcaacgttcttactcttagcggaacgttaagttccgacttaccatccgacgctaaggagctttaactttctngtggttccggcatggggggaacaggtggt

SEQ ID NO: 3763 - DNA, 400 bp; double-stranded, linear
tncactcaccgcagatttttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagctnaggatcctaagtctagtgcgtctgccaattccgccacacccgcaaatggtgagccatagaggattcgaacctctggaccctctgattaaaagtcagatgctctaccaactggagctaatggctcttccatggtgccggccagaggacttggaacccccaacctactggatttacaagttcaattgctctancaatttgagctaaggccgggcaatatgt

SEQ ID NO: 3764 - DNA, 610 bp; double-stranded, linear
ttaaagtattcccaattataattcttcatgattttcttattggatttcgaatttggtttcatgcattgatgtctcaaagaacatgatgaacagtcatcacattcatatagtttgaagtctcgtttaaaaccatatctatcattacggtatgcatatcttttaaaacctattcttttgttattaggacatataaattcattattaagttcgtcatatttccaattttgagtgttgaaaatgccacttttaaactttctagttttatctttaataaacatgccatacgtaataagtggcgttttattaaaatcatctataatagccatatagttttgctcactaccataacctgcatcagctacaatatactctggtaaataaccgaaggattttgaatcattgttaaaaatgggattaatgttctagtatctgttgggttttgaaataggtcataggataaaacaaattgrgaatttgtcgctatttggtaaattggtatcctggcttaagttgggccatttttccatatgggccttccttccattctccataaaagttggcatcatggatccagatccngttttaggaaaacctaattccaacctttaag

SEQ ID NO: 3765 - DNA, 400 bp; double-stranded, linear
cttcttggtgctgcatatcccctacaataattaaaccttttttcttatttaaaatgtgtcttaatgccgatgcatctatacttttttgatagtgcggtaaaatcttcatctcagangttaacaattctgttgcattcaaatcaggtgttaacggatctctaaatggcaagttaaaatgaattggccctttatgtggtccatataaatattgactagcaatttgcatttgatagtaaattgcacaatggtctctttactatcatccgcaataggcatatcgaactcatancttacataattattaaacatatttacttgattaatcgcttgtggtgcgcctacanttcttaattcagcggacggtcacttgttaaaacggtttaaggtattctactaattn

SEQ ID NO: 3766 - DNA, 451 bp; double-stranded, linear
cntttaacctttttaaggaatcctgctaatgcgggttttggcattttcgantntttrgtatctcacgcaatcttggtggtcattcagttcgtatatggcatccattaagacgcgaagatcaaatggactattgatgacttctggaataccacgatctatatttagtaattgataaacagcttccatggcagtacgaaccgaatattctgttgtaaatacagtgtctcgctctgtttctgcaaagttaccaataaatgctaagttctgagattgatgcgggacgactaaaggtctgtcgccgatagcacgcgtcatgaaataagatgtgatatatggcatataaacagggaatcgtattagatgcatgtnttgctaagtcttcaattttggtcagttgatacacctaagtggatacagccattcttggcatatttcattaccactacatnct

SEQ ID NO: 3767 - DNA, 400 bp; double-stranded, linear
acacgtgaacgtcttcaaatggaagtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttagatacacatgctatcactgatcaaattgactatttaacagctgacgaagaagatagctatgttgtagcacaagcaaactctaaattagatgaaaatggtcgtttcatggatgatgaagttgtatgtcgtttccgtggtaacaatacagttatggctaaagaaaaaatggattatatggatgtatcgccgaaccaagttgtttcagcagcgacacatgtattccatt

SEQ ID NO: 3768 - DNA, 400 bp; double-stranded, linear
cctacgaccgatcggttaacagccgatagctctaccactgagctactgtggattaatattatgcctggcaacgttctactctagcggaantaagttcgtactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcngctccacatgtcaccatgcttccacctcgaacctattaacctcatcatctttgagggatcttataaccgaagttggggaaatctcatcctgnagggggcttcatgcttagatgctttc

SEQ ID NO: 3769 - DNA, 400 bp; double-stranded, linear
cttgaccgaagttcttacctacatcacctaaattaatgacatgtccaccagtcatatactctaatccatggtcgccgataccttcaacgacaacatctacaccactatttctaatacagaatctttctnctgcactaccgttaataaatgccttaccacttgtcgcaccatagaatgagacgttaccagcaataatttcattttgtcgttcttcaaaaggtgctttgacaatgaccgtaccaccagataatcctttaccaacatagtcattcgcatctccagtatgatgaatcattaagcctttcggtgcatatgctgcaggactttggaccagcatgaccattcgtataaacattaattgtattttcagggaggtcctgcttctccatattgtttcgga

SEQ ID NO: 3770 - DNA, 400 bp; double-stranded, linear
cattacgtaattaaaagatagtcattaagagaggntgataaccatgcaagaagcatacattgtagcttatgggcgttcagcgcagcgaaacaaagcaaggcgcattattccacgaaagacctgatgatgtcgcagccaaagtattacaaggcgtattgaaacgtattgacggaaaattcaataagaatatgattgaagatgtcattgttggtacggcttttccagaaggattacaaggccaaaacattgcacgaacgattgcattgcgtgcgggattatctgacacggtaccggtcaaacagtggaatcgctactgctcatccaggntttacaaaccattcgcgattgcaggccaatcaaattatggcnggtccaaggagatatacttgttagctggtgg

SEQ ID NO: 3771 - DNA, 400 bp; double-stranded, linear
actctcttgcantaagggcagggaatgaccgatgggattaaaagatcaagctgttacctggggaaggtattttcatcaatttccagaactatccgataaagaatttaagactacacaaaaaattaaagatattttaacagaacatcatattagaatattagacttaccacttgcgactgggcttgttgctgaagtgggacaaggtctgagttgtatagctgttcgggctgacattgatgctttaccgattcaagagcttgttgaacaggattttaaatctgaaaatgaaggtgttatgcatgcgtgtggtcatgatattcacatggctagnattttggctacagctggtaaaattaaaagagattgagggcactcttactgggcgtgttaaatccatttg

SEQ ID NO: 3772 - DNA, 400 bp; double-stranded, linear
tttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcggctcatcgcatccattttttgcctgggcaacgttctactctagcgggaacggtaagttcggacttacca

SEQ ID NO: 3773 - DNA, 400 bp; double-stranded, linear
ttgatattcctgtaccacctataatcgttttaatcgatggggggacgcataggnataggcgacgtgcgattggattgcacgtctaagcagtaaggctgagtattaggcaaatccggtactcgttaaggctgagctgtgatggggagaagacattgtgtcttcgagtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggagaagggtgctctttaaggttaacgcccagaagagccgcatggaataggcccancgangtttattcaaaaacacagtctctgctaaa

SEQ ID NO: 3774 - DNA, 400 bp; double-stranded, linear
tacttagacaatcgaaagtgtacattattaaattatcatttccagttctactctagcggaacgtaagttggctaccatcctcgctaagaacctttcttgacttgtgacaatcgcttgcttctttcctctccttcggctctcacttactcatttagctctactaaactcgttgcgttcttttctcgtttcgtcagattcaaacgttttcacttcgccaagccatttttctttgtgtttgctttttattttgacgttttagacataaaaaaaagagaccttgcggtctcaaatgcggctcatcgcatccattttttgccggcaacgttctactctagcggaactaaagtcgnacttaccatcgacgctaaggagcttaaacttctgtgtttcggcatgggga

SEQ ID NO: 3775 - DNA, 400 bp; double-stranded, linear
cggtttatcaagaatggaaagagttgtacgtgaaagaatgtcaattcaagatactgagtctatcacacctcaacaattaattaatattcgacctgttattgcatctattaaagaattctttggtagctctcaattatcacaattcatggaccaagcaaacccattagctgagttaacgcataaacgtcgtctatcagcattaggacctggtggtttaacacgtgaacggctcaaatggaagtacgtgacgttcactactctcactatggccggtgtgtccaattgaaacacctgagggaccaaacattggattgattaactcattatcagttatgcacgtgtaaatggaattcggctttattgaaacaccatatcgtaaaagttgatttggntacacagc

SEQ ID NO: 3776 - DNA, 400 bp; double-stranded, linear
agcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacntaggcgattatttcttatggaattcaagcttatttaaaactctttattcactcggttttgcctgggtaaaatctanattttacttacntatctaggttttcaatgtacaaataatggtggggc

SEQ ID NO: 3777 - DNA, 400 bp; double-stranded, linear
aattataaaattaaatggcggtctcgacgggaatcgaacccgcgatctcctgcgtgacaggcaggcgtgttaaccnctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatgg

SEQ ID NO: 3778 - DNA, 400 bp; double-stranded, linear
caaatcctgcaccatcagaaagtggggcagatgttcctgcagtcatagtgccgtcagctttaaatactgtacgtaatttggctaatgcctccatcgtggtgtcagggcgtataaattcatcttggtcaaagatatttgtgtgtacttttggtcctgcgtttgtatattcaactgagtttacttgtattggaataatttcatctttgaaccgaccatcacgttgtgcgtcataggcacgttgatgacttctgacagcataagcatcttgatcttcgcgtgatacgtcaaattgggatgctacatttttcagcagttaaacccataggatatgacgcacctatatcatcatattgtaaggttggattgtttgtgggcttcgttngccaccnnttggtacggc

SEQ ID NO: 3779 - DNA, 400 bp; double-stranded, linear
cctatcaataacgggatttcattgaaataatacacaatcatgtatggtcatgcttattgccaatctaaatcgttcaaatttggcacaacgacaaataaggcttcaacacgaatatattctctcggttgaaaccttacttattcatttattttttataaattagtgacataacactgtattagcatctgcacgatcggttgaaatatatgttacattttcttgctgcttaataaatgcatcatagtaatcatattgcgacgaatgatatgtgccattcgatgtatcatttgggtttagcaaacagccataaccttcgtcatataaatgttcacngagcataaggggcgtcatgttttagaaccaccttacctacataaaattngcctccatagggatcata

SEQ ID NO: 3780 - DNA, 400 bp; double-stranded, linear
atggncggtctcgacgggaatcgcaacccgcgatctcctgcgtgcacacncaggcgtgttaaccgctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagc

SEQ ID NO: 3781 - DNA, 400 bp; double-stranded, linear
aaccacatctttatcaagtttcatattcggaataccatacattaataaaccgcctgattctctagcacgttcataaatagttacttgatatcctagtagattaagttcttcagcagcagctaatcctgctggaccgcttccaacgattgccactttttcatctctacggcgactcggaactttcggcgctacccaaccattttcaaaagcttcatcaataattgtgcgttcaatacctttaatcgcaatcgattctctattaatcttcatcacacaagcactttcgcatggtgcaggacatacacgccctgtaaagtcaggaaagttatttgtttcgcttaagcgtcataagcagttttaaaatcttgatgatacaccaagtcgtccantcaggatggag

SEQ ID NO: 3782 - DNA, 400 bp; double-stranded, linear
acatgatgcgtgtggtattggtttttatgcgaatatggataataaaaggtctcacgacatcattgataaatcgcttgaaatgttgcgacgcttagatcacaggggcggggtcggcgcagatggcatcactggtgatggcgcaggtattatgactgaaataccttttgcatttttcaaacaacatgtaacggactttgatatcccaggtgaaggtgaatatgccgtggggttatttttttccaaagaacgcattttaggttctgaacatgaagtagtttttaaaaaatattttggaaggcgangggttatcaattcttggttaacgtaatgtaccagttaataaaagatgccattgcctaaaccatgtagcagatacgatggccagtcattccaccaagtg

SEQ ID NO: 3783 - DNA, 400 bp; double-stranded, linear
aatcgggtgatgttggacgatgatacgcagggaacgttgcgttattcgtatatgaaatattggataactgttttaacaatgatggtagagatatttcatcatttgtaacatcgtcaattttgatattgtgatgatttaacataacgacatcatcgatattgaattggtatgaaaaacctgctgttgctgaatctgttaatttggctccaatatttaaaattaaatcgctgttgtccacataatctcgtattttatcttcggcaattttcccatcgtaaatacccatataatatggattttcctcattaaaagcaccttttcctaatgaaagttgtgctactgggtatctgtgtttganttacaaaatcttcnaagtcctggatggaggtgaaaactgtta

SEQ ID NO: 3784 - DNA, 400 bp; double-stranded, linear
ggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgcnaaacgttttcttttataaaaagantttaaacgcgttaatgaagctgtgagtgttccttcgaacacgagnnga

SEQ ID NO: 3785 - DNA, 400 bp; double-stranded, linear
tactggaatgacatcagatacatgtgcaccaccaatccatttcttttcaccattgataacccaagtatcgccttgncgttcagcgactgtttcaagacctcccgcaacgtccgaaccgtgttctggttcagttaaagcaaagcatgtacgcagttcatgtgactgtaatttaggtacatatttcgcaatttgttctttgctacctccgaaatagaaagtgttatgccctaaaccttggtgaacaccgagtagggtagctaaggaaatatcaaatcgcgcgagtaggtaagacatgaaaaactgaaatagttgactaggcattttggcgtttggacgatccttgtaaagtaatggattgttaaaataatttaattctcccagtctttaaatagtcctcggg

SEQ ID NO: 3786 - DNA, 400 bp; double-stranded, linear
tcatttgacgaatttcattgttattcaaaattctatctaatcgtgctttttcaacatttaatatcttacctcgtaatggtaaaatcgcctgcgttctagagtcacgaccagattttgtagaccccccggcagagtccccttcgactaagaaaatctcacattcttcaggacttttactagagcaatcggctaatttacctggaagcttgctacatctaacgctgatttacgacgtgttacttcacgcgcttttttcgcagcaacacgtgcacggcccgccataatacctttttcaaccactgtacgtgcgacttgtgggattttcatataaaaatcgttcaaagtgctctgagaataatttatctacaacttgacgcacttcagaattacctaattttgt

SEQ ID NO: 3787 - DNA, 400 bp; double-stranded, linear
tctcttcccgtttcgctcgccgctactaagggaatcgaantttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcggacactagcgattatttctnatgatncaagct

SEQ ID NO: 3788 - DNA, 400 bp; double-stranded, linear
attctctgctttcatctcatttggtgactaataccctgattttgtccaagtaaatgcttcataaagtattcttgaccttttgcagaacttgaaattaagtttgaacgccatatataatgattttggatgattctttttcaaatcaggatctctattgcaaattgtgtttgtnttgatttcacttcatcaattgcacgttgcaaaatcgcttcatttgaatctataccttcatctttagcttcttctgcaaacaacaaactatttttattaaattgtggatatgatggtaaccaaccaagtctagctgctaanacattataatcagctggatgttgatgctttaactcctctgttttagctaatggagattttaaacgatctacatttgactcttcataat

SEQ ID NO: 3789 - DNA, 400 bp; double-stranded, linear
cggtttcttaattatgaacgcaactatgaatggcttattaactatcacgggcacattggcaaaagatcagcttgcacaaaatggacaaggcatggtgctcggtatacaaacggttgaaaccggtgtttttggcgggattatcacaggtattatgaccgcaatacttcacaacaaatatcacaaagtggtattaccaccgtatttaggtttctttggtggctctagatttgtccctattgtcacagcatttgccgcaatctttttaggtgtattgatgtttttcatttggccaagcatacangccggcatttatcatgttggtgggatttgtaacgaaaacaggtgccatcggtactnttgtttatgggttcatctttaggattgttaggtccactcggtt

SEQ ID NO: 3790 - DNA, 716 bp; double-stranded, linear
ataatggactgtgccgngtaataatatngntctctaaaagttgtattttaaaaatagttctttaaattatatacccaccacatttggtgakgaacctaaaaaaaagcacttcccaaaaatggaaagtgcaagtagtgagccatagaggattcgaacctctgaccctctgattaaaagtcagatgctctaccaactgagctaatggctctaatggctgggctagctggattcgaaccaacgagtgacggatcaaangtccgttgccttaccgcttggctatagccaatatatagatggtggaggggggcagattcgaactgccgaacccgaagagcggatttacagtccgccgcgtttaccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcgtgntcttaaccgttgaccaaggagccatggctcaccaggtaggactcgaacctacgaccgatcggtttaacagccgatagctctaccactgagctactgtgggattaatattatgcctggcaacgttctactctagcggaactaaagttngaactnaccatcgacgctaaaggagcttaactt

SEQ ID NO: 3791 - DNA, 400 bp; double-stranded, linear
tgtcatgacgttatttgaagatatcgcgcaagtctttttaaaggtaacactatcatttatgcaatacggcgcattaccagagttgcatggtcaaaatatattgttgtcatttgaagatggacgtgtacaaaaatgcgtgttacgtgatcatgatactgtcagaatttataaaccatggctaacagcacatcagctttcattgccgaagtatgtcgtcagagaagatacacctaatacgctaattaatgaggatttggaaacattctttgcntgattttcaaacattagctgtgatcggtaaatctatatgccattattgatgcaattccaagatttatttggtgtgaagtgnagcatgaacttatgtcgttgttaaaacaaattttgaaaaaaggaagtg

SEQ ID NO: 3792 - DNA, 425 bp; double-stranded, linear
ttttcacacaatacatggacaccatggttcaatgcttctatagaaagatcagcatggaatttattaggtgtacaaatgaccaccgcatcaacaagtttaaacagctcgctaggtgtctcaactgcatgaggtatattaaagcgcttcgcaacatcaatcatctgcactgtattaatatcttgtactgcaactaatgagactgtgtctttgagtttcagcaatgctggaatatgacggtcttgtgcaataccaccaacacctatcacaccaacttttaattttgtcatgatgtgcctccttaccgtatgatgttattcaaagtaaattgctttgcctgatttkgcagactgataaatygcttcaagrrtttttgtaactaccatkgcttgttccgggttcacaactggntcagtatccanttacca

SEQ ID NO: 3793 - DNA, 400 bp; double-stranded, linear
gatgctctaccaactgagctaatggctctaatggctgggctagctggattcgaaccaacgagtgacggagnaaaggtccgttgccttaccgcttggctatagcccaatatatagatggtggaggggggcagattcgaactgccgaacccgaaggagcggatttacagtccgccgcgtttagccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcggtgtcttaaccgctttgaccaaggagccatggctccacaggtag

SEQ ID NO: 3794 - DNA, 400 bp; double-stranded, linear
atcagcagggttgaaagtacctgctgcaacagtaataccattattagttccagcaatacctgctacagttgctgcagatgcttctttcacccatggactcgtattattgcgacgtgtaaatgtntcacaacgttaccattacgtttaataactaatttatcagcgtatgtcgttacgttaccggcatgtgtattcactgtttggtttgctccaggtgcaattgtaatcgctcctgccgctgtttcagtcacagttggtttcgctggttgcacatcttttactacaaatttcgctggtaaagatgttgcaaaagtatgtccgttatagatgacgtccatattttgcgttaacgactttagccacattcggtttattcatagcggaccagtttgcgtccatt

SEQ ID NO: 3795 - DNA, 400 bp; double-stranded, linear
gcgccgaaaatgtaccggggctaaacatattaccgaagctgtggattgtcctttggacaatggtaggagagcgttctaagggcgttgaagcatgatcgtaaggacatgtggagcgcttagaagtgagaatgccggtgtgagtagcgaaagacgggtgagaatcccgtccaccgattgactaaggtttccagaggaaggctcgtccgctctgggttagtcgggtcctaagctgaggccgacaggcgtaggcgatggataacaggttgatattcctgtaccacctataatcgtttaatcgatggggggacgcagtaggataggcgaacgtgccatttgattgcacgtctaaagcagtaaagctgagtattaggcnaatccggtactcgttnaaggctgaact

SEQ ID NO: 3796 - DNA, 400 bp; double-stranded, linear
gcacatgttgccatgcttgagctaaattaccttgcatcattgctagcttttcttgtattaactgatatttactaattggtttgccgaattgcttacgctcagtgacataatctaatgtggcacgtaaagcgccaccataccacctgtagccatataagcaacgsctgctctcgttgaataaagaattttggcaatatctttaaagcttgttatgttttgtaagcgatccgcttcatctactttgacattagttaatttaattagggcgttaggaacaatgcgaagtgcgattttattatcaatgacttcaatatcgacgccatcttgttctggtctgactacaaagcaatggggtttgccagtttcngttatttactgcgaatactgggggggngnggtt

SEQ ID NO: 3797 - DNA, 400 bp; double-stranded, linear
ttgatgcagaagaggaaagtggaattccatgtgtagcggtgaaatgcgcagagatatggaggaacaccagtggcgaaggcgactttctggtctgtaactgacgctgatgtgcgaaacgtggggatcaaacaggattagataccctggtagtccacgccgtaaacgatgagtgctaagtgttagggggtttccgccccttagtgctgcagctaacgcattaagcactccgcctggggagtacgaccgcaagttgaaactcaaaggaattgacggggacccgcacaacggtgggagcatgtggtttaattcgaagcaacgnagagaaccttaccaatctttgacatccttttgacactctaggagatagagccttcccttcggggggacnaagtgacagttg

SEQ ID NO: 3798 - DNA, 400 bp; double-stranded, linear
cacaaaacaagccaagcaaaacaaacgcatataacgtaacaacacatggaaacggccaagtatcatatggcgctcgcccaacacaaaacaagccaagcaaaacaaatgcatacaacgtaacaacacatgcaaacggtcaagtgtcatacggagctcgcccgacatacaagaagccaagtaaaacaaatgcatacaatgtaacaacacatgcagatggtactgcgacatatgggcctagagtaacaaaataagtttgtaactctatccaaagacatacagtcaatacaaaacattacgtatctttacaacagtaatcatggcattctatggatgcttctaactggaattaaagcatcggaacaatcgggangcatatttctaaaattatttattccattat

SEQ ID NO: 3799 - DNA, 400 bp; double-stranded, linear
cttcgccgatatgggggaagctaggtgataagatcagccgaaaatggatggtgttaagagcgttacttggtttggcggtatgcttatttttaatggcattgtgtacgacaccattacagtttgtacttgtgaggttattgcagggactatttggtggtgttgttgatgcatcaagtgcgtttgcgagtgcagaggcgccactgaaggatcgtggaaaggtattaggaagactgcaaagttcagtcagcgcaggtctcttgtggggccattaattggcggtgttacagcttcgatattaggttttagtgcgttactgatgagtattgccgttattacttttattgtctgtnttttcggtgccattaaaatgattgaaacgacacatatggccaaanncaca

SEQ ID NO: 3800 - DNA, 400 bp; double-stranded, linear
ggaatctattatattagatgtaaaaaatttcgcgcaaaatgtgttaggtaaaggtgtcattgtcgtcaatgatgtgcctggctttgtcgcaaatagagtcggcacgcaaacaatgaatgatattatgtatcgcgccgagcaacacaagataagcattgtagatgtggatgctttaactgggcaagcgattggtcgtcctaaaacaggtacatatgcgctatctgacctagtcggtttagatattgcagtgtctgtaaattaaaggcatgcaacaagtacctgaagaaacaccttattttcatgatgtcaaaatgtaaatacgttgtttgaccatgggcgcactcggacgttaanncgnaaaccaagggtttttaccaaaaagggttaaagggnaacttaa

SEQ ID NO: 3801 - DNA, 400 bp; double-stranded, linear
tgcaggcgtttctggtctgcatagtttacgcatacgacctgcgcgatccttatctggtaataaattgtaaaacgatagttcccgttgttcctaatagttgtattctatctgacgcataatgtgaaaaataacctgccatctctaagcccggtcttgatatatcagcatttttaattggcttcgatagtccttcttcaccagcgattaaatctaactttaatgtttcaactagtttttctgtcgttaacatgggttcacctcaattgtatttaccctactcttacatctcttcttatcatatcaaaaatataacaccaatctacattgaaaagctaaantaaatattaatgttcattattgttatnattttacaagtcaatatcatcataatttattgctg

SEQ ID NO: 3802 - DNA, 400 bp; double-stranded, linear
tttcacttttgaaccatgcggttcaaaatgattatccggtattagctccggtttcccgaagttatcccagtcttataggtaggttatccacgtgttactcacccgtccgccgctaacatcagagaagcaagcttctcgtccgttcgctcgacttgcatgtattaggcacgccgccagcgttcatcctgagccaggatcaaactctccataaaaattatgatgtttgattagctcataaatactaaataatgtttgtaacttatagttacgttttttggaattaacgttgacatattgtcattcagttttcaatgttcatttttcttaccgacaagaattaattatacattttattaacatttaagtcaataactttntttatcctgtccatttnattttt

SEQ ID NO: 3803 - DNA, 400 bp; double-stranded, linear
tagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataaccgaagttgggaaatctcatcttgaggggggcttcatgcttagatgctttcagcacttatcccgtccacacatagctacccagctatgccgttggcacgacaactggtacaccagaggtatgtccatcccggtcctctcgtactaaggacagctcctntcaaatttcctacgnccangacggatagggaccgaactgttttcacgacggtnctgaacc

SEQ ID NO: 3804 - DNA, 457 bp; double-stranded, linear
agtncactcacnccagatgtttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagttagwatcctaagtctagtgcgtctgccaattccgccacacccgcaaatggtgagccatagaggattcgaacctctgaccctctgattaaaagtcagatgctctaccaactgagctaatggctcttccatggtgccggccagaggacttgaacccccaacctactgattacaagtcagttgctcttaccaattgagctaggccggcaatatgtaagaataaatggtggagaatgacgggtttcgaaaccgccgnaccctctggcttgttaagggcag

SEQ ID NO: 3805 - DNA, 400 bp; double-stranded, linear
actttttattttgacgttttagacataaaaaaagctcacggtctcaacttgcctggcaacgttctactctagcggaacgtagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttatnttgacgttttaggcataaaaaaaagagaccttgcggtctcaatgcggctcatcgcatccatnttttgccgggcaacgttctactcttagcggaacgtaagttggctaccatcgtcgctaaagacctttttggactgtg

SEQ ID NO: 3806 - DNA, 400 bp; double-stranded, linear
gttatgaaagtcgcgcttaaaatgcgttaatgtgacaaggataattcaacatcgtttcattttactgagtcattgcacttatcatacacattatatttagcatgagttatattactaaaacaatattacatgcgcattagtactagaatggagttttttcaatgcgacttattttaatcgtcattggcttaatatttacagcgcttggtattgcaggtgccgtattacctttactgccaacgaccccttttttactcgtagcagttttttgctttgctcgaagttcagatcgcttttacaattgggcnnattaatcaaaaaatttataaagaatatgtagaaaacctttntttgacatcgaggctacacgctacaacagaaaattgaaaatttaattagc

SEQ ID NO: 3807 - DNA, 388 bp; double-stranded, linear
aggagaacatgctgttacatttggagagcctgctattgcagtgaccgtttaacgcaggtaaaatcaaagttttaatagaagccttagagagcgggaactattcgtctattaaaagcgatgtttacgatggtatgttatatgatgcgcctgaccatcttaagtctttggtgaaccgttttgtagaattaaataatattacagagccgctagcagtgaacgatccaaacgaatttaccaccatcacgtggattaggatcgagtgccagctgtcgcggttgcttttgttcgtgcaagttatggattttttagggnaaatcattaacgaaagnaagaactcattggaaaaggctnattgggccagaagcaaattgccacatggtaaaaccaa

SEQ ID NO: 3808 - DNA, 447 bp; double-stranded, linear
atgcgcagagtatatggaggaacaccagtgtcgaagcgcactttctggtctgtaactgacgctgatgtgcgaaacgtgkgggatcaaacaggattagataccctggtagtccacgccgtaaacgatgagtgctaagtgttagggggtttccgccccttagtgctgcagctaacgcattaagcactccgcctggggagtacgaccgcaagttgaaaactcaaaggrattgacggggacccgcacaagcgtgggagcatgtggtttaattcgaagcaacgnngaggaaccttaccaaatcttgacatcctttgacaactctagagatagagccttccccttcngggaacaaatgacaggtggtgcatggttgtcgtcagctcgtgtcgtgagatgttgggtttaantcccgcaacgagcgcaacccttaagcttatttgccatcattaa

SEQ ID NO: 3809 - DNA, 400 bp; double-stranded, linear
ccaactgagctactgaaccataataaaaatgtaatgactggcggtctcgacgggaatcgaacccgcgatctcctgcgtgacaggcaggcgtgttaaccgctacactacgagacctataaaatattgcgggaggcggatttgaaccaccgaccttcgggttatgagcccgacgagctaccgaactgctccatcccgcgataataaaaaataatggcggaggaagagggattcgaacccccgcggcccgttaaggccctgtcggttttcaagaccgatcccttcagccggacttgggtattcctccattattataggtaaatcgctattaattataaaattaaatggcggtctcgacgggaatcgaacccgcgatctcctgcgtgacaggcaggcgtgttaa

SEQ ID NO: 3810 - DNA, 400 bp; double-stranded, linear
tgcttggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgnattcaccg

SEQ ID NO: 3811 - DNA, 380 bp; double-stranded, linear
gcttcatgcttagatgctttcagcacttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggaactcttgggggagataagcctgttatncccggggtagcttttatccgttgagcgatggnncttccatgcgggaaccaccgggatt

SEQ ID NO: 3812 - DNA, 386 bp; double-stranded, linear
gagggatcttataaccgaagttgggaaatctcatcttgaggggggcttcatgcttagatgctttcagcacttatcccgtccacacatagctacccagctatgccgttagcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagcaaccccttgggaccgactacagccccaggatgcgatgagccgacatcgaggtgccaaacctccccgtcgntgtgaactcttgggggagataagctgttatccccgggtgagntttntccgttga

SEQ ID NO: 3813 - DNA, 400 bp; double-stranded, linear
gttggagtttctggctcactcggcacttctggtgtcggtggtgttggtgtttccggctcacttggtacttctggtgttggtggcgttggtgtttccggctcacttggtacttctggtgtcggtggcgttggtggcacgattggaggtgttgtatcttcttcaatcgtttgttgaccttcattttggccgcttacttttggaagtgtatcttcttcaaagtcaacactattgtgtccaccgaattgataacttggtttatctttatttgtatcttcttcaataatttcagtgtgcttattgaatccgtgaatatgtggcacntggtcgaagtcgatatcaatgatgttaccgccatgttcatacttaggtttgtctttttctgtancttcctcgaatgact

SEQ ID NO: 3814 - DNA, 400 bp; double-stranded, linear
taattgggctaccatcgtcgctaaagacctttcttgacttgtgacaatcgcttgcttctttcctctccttcggctctcgcttactcatttagctcnactaaactcgttgcgcncttttctcgtttcgtcagattcaaacgttttcacttcgccaagccatttttctttgtgtttactttttattttgacgttttaggcataaaaaaaagagaccttgcggtctcaatgcggctcatcgcatccattttttgcctggcaacgttctactctagcggaacgtaagttgggctaccatcgtcgctaaagacctttcttgacttgtgacaatcgcttgcttctttcctctccttcggctctcgcttactcatttagctctactaaactcggtgcgctcttttct

SEQ ID NO: 3815 - DNA, 400 bp; double-stranded, linear
ttctttcatatgattttttagattttagtaagtcaataaagccaattttctccaacgattgaatgtaacgttgattgataaatgtatttcttggtaaatcaccacccgctaaaattgtggcgatatttaaggcaatatgataatcatggtcgctaataaaatgaccccgtctttgcgcatctaattgtccttggatcaatgctttgaagtcttcacctaaagcgatatattgatgtctaggattcggaatatagtttgtttctgcttcatatttcgcacgtttgagcgcaacttcgacacgttgtgctgtattgaaaataatcgtatctggtatcacgtaaatnaccataacgacgtgcctccaaaggcatttggtangagccttcggcaatgccgataa

SEQ ID NO: 3816 - DNA, 400 bp; double-stranded, linear
ccaatatttatattaatgaaaataagatgttatattcattgttaatttaacacatagtaaganaaacagtcataaattgatttctaattgaaatcatcttatgactgctttttattatactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaantaagtcggactaccatcgacgctaaggagcttaacttctgtgttcggcatggggaacaggtgtgacctccttggctatagtcaccagacatatgaatgtaaattcatacattc

SEQ ID NO: 3817 - DNA, 400 bp; double-stranded, linear
tgttattgttcaaaatcatgatcaagatcagtatatcggggggnattatgaagcgatgcatacattatcacataataagattaaatcacaattacgtatgaccttaccggagtacatgataccagttaatttcatgcatattgagcaaattcctattactattaatgggaaattagataagaaggcattgcctatcatggactatgtcgatacggatgcctatgtagcaccgagtacagataccgaacacttgctatgccaaatttttgcagatattttacatgtgaatcaagtaggtattcatgataatttctttgaattaggtggccattcattaaaagcaacgttatggntggaatcggatagaggcatctactggggaaacgattaccaattgggg

SEQ ID NO: 3818 - DNA, 400 bp; double-stranded, linear
tcggaatctgggaggaccatctcctaaggctaaatactctctagtgaccgatagtgaaccagtaccgtgaggagaaggtgaaaagcaccccggaaggaagttgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcanaacatgttctgaatagggcgtttagtatttggtcgtagccgnaaaccaggtgatctacccttggtccaggttgaagttcaggtaacactggaatggaggaccgaaccgacttacgtttgaaaagtgagcggatgaactgaaggtagcggagaaattcccaatcgaa

SEQ ID NO: 3819 - DNA, 400 bp; double-stranded, linear
caacgagagactcggtgaaatcatagtacctgtgaagatgcaggttacccgcgacaggacggaaagaccccgtggagctttactgtagcctgatattgaaattcggcacagcttgtacaggataggtaggagcctttgaaacgtgagcgctanttacgtggaggcgctggtgggatactaccctagctgtgttggctttctaacccgcaccacttatcgtggtgggagacagtttcaggcgggcagtttgactggggcggtcgcctcctaaaaggtaacggaggcgctcaaaggttccctcagaatggttggaaatcattcatagagtgtaaaggcataagggacttgactgcgagacctacaagtcgagcaggtccaaaaacggacntagtgatncggt

SEQ ID NO: 3820 - DNA, 400 bp; double-stranded, linear
tggctcgaaccaccgacctcacgcttatcaggcgtcgctctaaccagctgagctataggccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgttattcaccgtagcatgctgatctacgattactancgattccagcttcatgtagtcgagtttgcagactacaatncgaactg

SEQ ID NO: 3821 - DNA, 400 bp; double-stranded, linear
tattaaattaatggtgggcctaantggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactnagcgnttccagcttccatgnta

SEQ ID NO: 3822 - DNA, 400 bp; double-stranded, linear
tctaccaactgagctaatggctctaatggctgggctagctggattcgaaccaacgagtgacggataaagtccgttgccttaccgcttggctatagcccaatatatagatggnggaggggggcagattcgaactgccgaacccgaagagcggatttacagtccgccgcgtttaccacttcgctacccctccagcttattcatataatttaataatcaaaatggtgggagaatgacgggttcgaaccgccgaccctctgcttgtaaggcagatgctctcccagctgagctaattctccaaaataatgactcctacggactcgaacccgtgttaccgccgtgaaagggcggtgtcttaaccgcttgaccaaggagccatgctccacagtaggattcgaactaa

SEQ ID NO: 3823 - DNA, 391 bp; double-stranded, linear
aacttgcctctttaggtacagcatgaggccctaggaaagtatgtttcatgtctaaatcatatttctcagctaaacgattagacactttcaattgcttcagttcattttctctatctaatccataaccactcttactttcaactgcangcacgccgtgtttaatcatagtaagcaaatcatgctctgcttttttaaacaagtcatcttcggatgtttctctagtagcattaacggtagataatatgccaccacccatttctaatatttcaaggtaagacttacctggacgttttaatgacatctcatgttctcgagatccaccaaatgtnaaatggggtatgtggcatctactaagccgggggacactanctttcccactaggcatcaatcg

SEQ ID NO: 3824 - DNA, 400 bp; double-stranded, linear
acatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtggagtgttctttcgaacactgagcgattatttcttatgaattcaagcttatttaaaactctttattcactcggttttgcttggtaaaatctatattttacttacntatctagttttcaatgtacaattctttttagtcaagcgctcgcataagcaatatcactttgaaccaaaaaagattggaaggtgaaataaacattcaa

SEQ ID NO: 3825 - DNA, 400 bp; double-stranded, linear
atcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacactagcgattatttcttatgaattcaagcttatttaaaactctttattcactcggttttgcttggtaaaatctatatnttacttacttatctagttttcaatgtacaatttctttttagtcaagcgctcgcataagcaatatcactttaaccaaaaaatatttgaatgtnaaataaacattcaaaactga

SEQ ID NO: 3826 - DNA, 400 bp; double-stranded, linear
tcactcaccgcagatttttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagncttagatcctaagtctagtgcgtctgccaattccgccacacccgcaaatggtgagccatagaggattcgaacctctgaccctctgattaaaagtcagatgctctaccaactgagctaatggctcttccatggtgccggccagaggatttgaacccccaaccttattggttacaagtcagttgctcttaccaattgagctaggncggcaatatgttaagatta

SEQ ID NO: 3827 - DNA, 400 bp; double-stranded, linear
agtggtggaatggtcttaaaagttggtggtctaactttagagaagaccaaaagaagaaaagtgataaatacgctaaagaacaagaagaaacagctcgtagaaacagagaaaatataaagaaatggtttggaaatgcttgggacggcgtaaaaactaaaactggtgaagcctttagtaaaatgggcagaaatgctaatcattttggcggcgaaatgaaaaaaatgtggagtggaatcaaaggaattccaagcaaattaagttcaagttggagctcagccaaaagttctgtaggatatcacactaaggctatagctaattagtactggtaaaatggtttggaaaagcttggccaatctgttaaattcgactacaggaagtatttacattcaaactaggcaaa

SEQ ID NO: 3828 - DNA, 400 bp; double-stranded, linear
tctcagttccagtgtggccgatcaccctctcaggtcggctatgcatcgttgccttggtaagccgttaccttaccaactagctaatgcagcgcggatccatctataagtgacagcaagaccgtctttcacttttgaaccatgcggttcaaaatattatccggtattagctacggtttcccgaagttatcccagtcttataggtaggttatccacgtgttactcacccgtccgccgctaacatcagagaagcaagcttctcgtccgttcgctcgacttgcatgtattaggcacgccgccagcgttcatcctgagccaggatcaaactctccataaaaattatgatgttgantagctcataaatactaaataatgttgtaacttatagtacgtttttngaaat

SEQ ID NO: 3829 - DNA, 400 bp; double-stranded, linear
caagcgccatgacatcataactttcttgcacaagatatgtgaacggcggtgttgatcctagattcgtggcatgcatacgcaaaccattttcttcaattacttcaccaaggcgtttaaaatctttgtcttgaatcgctgcttttgcttcagctaaatcttcatcaatatgatctaaccaatattgataaaaccttgatgtgtttcgtgtcaatgacataccatatcgactaggtacctttttagaatgttgattaatcacaacaaatatcatggcaaggtcatcttcaaaatgattcgattcaagtgggarsggcatatgacgtctcatcactataccctttntncccattctgcaaatncacccataaatactacgggacggagaacccgtacccatttc

SEQ ID NO: 3830 - DNA, 400 bp; double-stranded, linear
gggtactaagatgtttcagttctccgggtgtgccttctgatatgctatgtattcacatatcgataacatgacataactcatgctgggtttccccattcggaaatctctggatcaaagcttacttacagctccccaaagcatatcncgttagtaacgtccttcatcggcttctagtgccaaggatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtggtccttcgaacactagcgatna

SEQ ID NO: 3831 - DNA, 400 bp; double-stranded, linear
aaatgcggctcatcgcatccattttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctgggcaacgttctactctagcggaacgtaattgggctaccatcgacgctaagaacctttcttgactgtgacaatcgcntgcttctttcctc

SEQ ID NO: 3832 - DNA, 400 bp; double-stranded, linear
agcttattttaaaacgtcgtttattcactctggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtatttca

SEQ ID NO: 3833 - DNA, 400 bp; double-stranded, linear
ttttcttctggtaaaatatctgcaataacagtatctatgcctacttgttttgcaatggcttgagcagtgtttttattatcgccagttaacatggcaacttcaatgcccatatcatgcaattgtattatagcatctttggcatgatctttgacagtatctgccactgcnatgataccagttaatgaataattaacagcaatgagcatagcagttttaccatctcgttcataatgtgttaaatcatcagaaatatgcttaggcaagctaatatcattgtcagccattaatntacgggttaccaaccaatatatggtgatgatcaatccgtggcttcaataccatggccaggtaccgcttnaaagttgttgtctcagttaatattaattgctttccttttgca

SEQ ID NO: 3834 - DNA, 400 bp; double-stranded, linear
naattatatggaccttgcaggactcgaacctgcgaccgaacggttatgagccgttagctctaaccaactgagctaaaggtcctaaatataattttacaactaataaatagtngcggnngaggggatcgaacccccgacctcacgggtatgaaccgtacgctctagccagctgagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcga

SEQ ID NO: 3835 - DNA, 400 bp; double-stranded, linear
aataacaattgcgccactaaaactcaaaatttccaccaccaacatccaaattatcaacatcgcaacataaccaaatgttataataaatctattacacaaagagataaattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgattttctatcgcttcttatctgaaaaagccgaacaagnatatgcagatgccttgtcaggtgaagacatcacgtatcnagaagcgtgggcagatgaagaatatcgtgaagacttnaaaagcaggaattaattggttcaagtcg

SEQ ID NO: 3836 - DNA, 400 bp; double-stranded, linear
ctaatcgcatctttttcaatctaagtgcgtttgtgacaaacttactgaacttagtgccattgcagcaccagcaacccatggcgcaagtaagcccaatgcagctatagggataccggcaatattatagccgaatgcccaaaatagattttgacgaatattacgaatggttgctttacttgcataaatggctttaggaataagcatcaagtcgccaccaagaatagtaatatcagctgcttcaatggcaacttctgtacctgtaccaatggcgataccgatatcagctttaactaaatgcaggtgcatcatttacaccgtcaccaaccatcgcaaccttcttacctgttggctgtagtttcgcaattgtggcagctttttncttccggngaaaatatcnggc

SEQ ID NO: 3837 - DNA, 400 bp; double-stranded, linear
agagcggatttacagtccgccgcgtttaccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcgtgtcttaaccgcttggaccaaggagccatggctcaacaggtaggactcgaacctacgaccgatcggttaacagccgatagctctaccactgagctactgtgggattaatattatgcctggcaacgttctactctagcgggaagtaantcggactaccatcgacgctaaggagcttaacttctgtgttcggcatgggg

SEQ ID NO: 3838 - DNA, 400 bp; double-stranded, linear
aatcgcttgcttctttcctctccttcggctctcgcttactcatttagctctactaaactcgttgcgctcttttctcgtttcgtcagattcaaacgttttcacttcgccaagccatttttctttgtgtttatttttattttgacgttttagacataaaaaaaagagaccttgcggtctcaaatgcggctcatcgcatccattttttgcctggcaacgttctactctagcggaagtaattgggctaccatcgacgctaagaacctttcttgacttgtgacaatcgcttgcttctttcctcttcttcggctctcgcttacncatttagctctactaaactcgttgcgctcctntctcgtttcgtcagatccaaacgttttcantcgnccaagccaatttgcct

SEQ ID NO: 3839 - DNA, 416 bp; double-stranded, linear
ttacggccgccgtttactggggcttcgattcgtagcttcgcagtagacrcgactcctcttaaccttccagcaccgggcaggcgtcaccctgatacatcaccttacggtttagcagagacctgtgtttttgataaacagtcgcttgggcctattcactgcggctcttctgggcgttaaccctaaagagcaccccttctcccgaagttacggggtcattttgccgagttccttaacgagagttcgctcgctcaccttagaattctcatcttgactacctgtgtcggtttgcggtagggcacctattttctatctagaggcttttctcggcagtgtgaaatcaacgactcgaggacacaatgtcttctccccatcacagttcagccttgaacgrgtaccggatttgnctaatgattcag

SEQ ID NO: 3840 - DNA, 400 bp; double-stranded, linear
aagttaggctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaaacttgcctggcaacgttctactctagcggaacgtaagttggctaccatcgtcgctaaagacctttcttgacttgtgacaatcgcttgcttctttcctctccttcggctctcgcttactcatttagctctactaaactcgttggngctctttttctcggtttngtcaganttcaaa

SEQ ID NO: 3841 - DNA, 400 bp; double-stranded, linear
cgcgactgangaatacaatgnctacgataactaaacccaatcaatcttttcattctatcaattcctttcaaaatcttcactatatatcattaatgtctacgtatgaatctagctagaacattccctagcgtttgaatcacttggacaataatgactaatacaataacggtaataataatgaccgtcgtatcaaatctttgataaccatacactaaagctaagtctcctataccaccaccgccaacagctcctgccatcgccgtacttccaataagtccaataatcgcagtggtaattgctaatactaacgaacctaaagcttcaggaattaaaaaatatctaatgatttgtagtggtgaagcgcccatcgctttcgccgcttcaataatcccctcgtcta

SEQ ID NO: 3842 - DNA, 400 bp; double-stranded, linear
tcgcgattcgcgtgttcagaaatcatcggcatcgcgtcattcaatgattcatatgcatctaaagcaatagaagataatgtgtctggcacatatacccatgccaacgtatcagtagacgtatgatgttctgctaccgcaaaaacagttgtctctggaatatacacacctgattgttttaatccttgtctgacatttggacgattacatatcatcgctaataacttagcattaaaaccgcttgatgcgccaccacaagccccacattcaagtgatgcatgatgtggattattgtgagaatgactagcatgacctgctaacacaacgaacggcgcaaatgcttcggktaaatccatcaatttcaacgctgtaacgcgaatcaattgctctgctcagtaaatcc

SEQ ID NO: 3843 - DNA, 400 bp; double-stranded, linear
ggcgcagtgtcactcgactagtgagctattacgcactctttaaatgatggctgcttctaagccaacatcctagttgtctgggcaacgccacatccttttccacttaacatatattttgggaccttagctggtggtctgggctgtttcccngtcgaacacggaccttatcacccatgttctgactcccaagttaaattaattggacattcggagtttgtctgaattcggtaacccgagaggggcccctcgtccaaacagtgctctacctccaataatcatcacttgaggctagccctaaagctatttcggagagaaccagctatttccaggttcgattgggaattctccgctaacctcagttcatccgntcactttcaacgtaantcgggtcgggtctcca

SEQ ID NO: 3844 - DNA, 469 bp; double-stranded, linear
acttttacttgctgcgcctccagccaaacctgctgttccagcaccgatcgctgcaccttttttgccattatgatgatctttagacttatcttgagacgctttatcctcagtcgagttattcgccttgccagaattacttttgttttgagcgtcatttgaatgtttcttagctttagaagcagccattgcaccagctgcacctgcaacacctgctgttccagcaccaatagctgctgcttttttaccattatgatgttctttaggttcatcttgatcttgttttacagaatcattatcatgttcattttttgatgtttctgattggttagcacctgttgtaaaatatggtttaggttgctgagattgttcagcttcactcttatcagaaactgttgaatgctcagtgttattttctgcatttttaatagtatcgtgtttanccattgtcctcgaatgggttcnggatgtg

SEQ ID NO: 3845 - DNA, 400 bp; double-stranded, linear
gcttcactaccaagtgaagaagttgctgaaactcctgcagcacctgcancagtaacattagaaggcgacttcccagaaacaactgaaaaaatccctgctatgcgtagagcaattgcgnaacatggntttaactctaagcatactgcacctcatgtaacattaatggatgaaattgatgttcaagcattatgggatcaccgtaagaaatttaaagaaatcgcagctgaacaaggtactaagttaacattcttaccttatgttgttaaagcacttgtttctgcattgaaaaaatacccagcacttaacacttcattcaatgaagaagctggtgaaatcgttcataaacattactgggaatatcggtattgcagcagacactgatagaggattattagtacct

SEQ ID NO: 3846 - DNA, 400 bp; double-stranded, linear
ttaagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttgggctaccatcgtcgctaaagacctttcttgacttgtgacaatcgcttgcttctttcctctccttcggctctcgcntactcatttagctctactaaactcgttggcgctcttttctcggttcgtcagattcaaacggttt

SEQ ID NO: 3847 - DNA, 400 bp; double-stranded, linear
atcgtcaacttattattagacgatgtacaagttacattagacaaaaaaggtattacgatggacgtttctcaagatgcgaaagattggttaattgaagaaggctatgatgaagaattaggtgcacgtccattaagacgtattgttgaacagcaagtacgtgacaaaattacagattactatttagatcatacagacgttaaacatgtggatatagatgttgagggataacgaattagtcgtaaaaggtaaataacgacactttaacatatcgcgcatcaaaaatgagcatcaggtcgcccttgcctgtggctcatttttttgaattatttccctgggaaaatgattcgctgtgtgctgttctgttnccacaacaatcacgattgaatgtgcacatgtgacc

SEQ ID NO: 3848 - DNA, 400 bp; double-stranded, linear
tttaaaactctttattcactcggttttgcttggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacattcaaaactgaatacaatatgtcacgttattccgcatcttctgaagaagatgttccgaatatatccttagaaaggaggtgatccagccgcacctttccgatacggctaccttggtnacgacttcaccccaaatcatttgtcccaccttcgacggctagctcctaaaaggttactccaccggcttcgggngttacaaactctcgtgggtgtgacnggcgg

SEQ ID NO: 3849 - DNA, 400 bp; double-stranded, linear
gtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtctcaatgcggctcatcgcatccattttttgcctggcaacgttctactctagcggaacgtaagttggctaccatcgtcgctaaagacctttcttgacttgtgacaatcgcttgcttctttcctntccttcggctctcgctt

SEQ ID NO: 3850 - DNA, 463 bp; double-stranded, linear
gtctactaatgttacaaccacacctgattaattgcttttttagcagtaattgccacatctgtgtgacgataatgatatgcgacagttaataatttgtgatttttattagccgcttcaatcatgcgatcacactcttccgtcgtcatcgccattggcttttcacacaatacatggacaccatggttcaatgcttctatagaaagatcagcatggaatttattaggtgtacaaatgaccaccgcatcaacaagtttaaacagctcgctaggtgtctcaactgcatgaggtatattaaagcgcttcgcaacatcaatcatctgcactgtattaatatcttgtactgcaactaatgagactgtgtctttgagtttcagcaatgctggaatatgacggtcttgtgcaataccaccaacaactatgcacaccaacttttaantttgtncatgatgtgccngcttnaccg

SEQ ID NO: 3851 - DNA, 628 bp; double-stranded, linear
tatgctctaatgctgggcttagtggattcgaccaacgagtgacgnagtcaaagtcngttgctttacgcttggctatagccccaatatatagatgttggagggggcagattcgaactgccgaacccgaaggagcggatttacagtccgccgcgtttagccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcgtgtcttaaccgcttgaccaaggagccatggctcacaggtaggactcgaacctacgaccgatcggttaacagccgatagctctaccactgagctactgtggattaatattatgcctggcaacgttctactctagcggaacgtaagttcggactraccatcgacgctgaaggagcttaaacttctgtgttcggcatgggaacaggtgtgacctccttgctatagtcaccagacatatggaatgtgaatttgatgacattgcaaaantagnttagtaagtaaaagtggattttggnttn

SEQ ID NO: 3852 - DNA, 400 bp; double-stranded, linear
taaagatttaaaagtagctgttattggnacaggtcgaattggccgtgtagtagccgatatatttgccaatggttatcaaagtgatgtggtcgcatacgaccgtttcctaatgctaaaattgcaacgtatgtcgattacaaagatacgattgaggaagcggttgaaggtgctgatatcgtgacattacatgtacctgcaacgaaatataatcattatctatttaatgctgaattatttaaacattttaaaaagggcgcntatttgtcaattgtgcgagaggttctttagtaggatactaaggcgttattagacgcattagacaatggtgtgattaaaggtgcagcacttgnttacgtatggatttggaacggcaaactttttcccaagtggtccaaagggg

SEQ ID NO: 3853 - DNA, 400 bp; double-stranded, linear
tcttaaacattagccacagctaattgtgacttaaaaataggaatacatgagtaaaactcatcataagaaatactaatttctatagaaaaagtattactttatcgttgtcccaccccaacttgcacattattgtaagctgactttccgccagcttctgtgttggggccccgccaacttgcacattattgtaagctgacttttcgtcacttgctgtgttggggccccgccaacttgcacattattgtaagctgacttttcgtcacttnctgtgttggggccccgccaacttgcattgtctgtagaaattgggaatccaatttctgctatgttggggcccacaccccaactncgcattgcctgtagaatttcttttcgaaattctctgtgttgggggcccaca

SEQ ID NO: 3854 - DNA, 400 bp; double-stranded, linear
gtgcaatctgcgttaacaaatgtaaatcgtgtcaatgagcgattaacgcaagcaattaatcaattagtacctttagctgataatagtgctttaaaaactgctaagacgaaacttgatgaagaaatcaatanatcagtaactactgatggtatgacacaatcatcaatccaagcatatgaaaatgctaaacgtgcgggtcaaacagaatcaacaaatgcacaaaatgttattaacaatggtgatgcgactgaccaacaaattgccgcagaaaaaacaaaagtagaagaaaaatataatagcttaaaacaagcaattgctggattanctccagacttggcaccattacaaactgcaaaanctcagttgcaaatgntattgtcagccacgagtacggctggta

SEQ ID NO: 3855 - DNA, 400 bp; double-stranded, linear
tgtgtgaaaaaccaatggctgaaaacgacagcagaagctcaaaaaatgatagatacagctaaatcaacaggtaaaaaattaacaataggttatcaaaatcgtttccgagcagatagtcaatttttacatcaagcagcgcaacgtggcgacttaggagacatttacttcggaaaggcacatgccattcgtcgtcgagcagtaccaacatggggtgtctttctagacgtagtaagctcaaggtggaggaccattaatcgatatcggtacacacgctttagatttaacgttatggatgatggatanttatggaaccagaatcagtgatgggtttcaacattccataaattnaataaacagcctcatgcgggcaaacgcttggggtttcaggngttccagatgg

SEQ ID NO: 3856 - DNA, 400 bp; double-stranded, linear
cgttctcaatagaatgatttaaatcttcgatttctttatctaaatgactaccaattaaatctatttcttctattgttaaatcgctatctccatcttcttttatctctggtattattttttcttcaactaagtcacgatataatgtttttgaattttcgttcaatttcgattcgtgattttgaatacttttcttccacacaaatgtatatctattggcattagcttctacttttgtaccatcaataaaaattgaattattatcaataagattttgctttaaacattgactatggaactgaataaataaagattcaattaacgcatcagtattaggattcactctaaaacgattaatagttttataagaaggnggttggancntgagcgaaccacancatcc

SEQ ID NO: 3857 - DNA, 381 bp; double-stranded, linear
ggcataccatggtcaaacgcgtgatgatcaagtaacatcacatgttcaacatatttttgaagttgtgaatgcacatggtaaacatttttgtgcattaccacgtgaagatgaagatattgcaaaatggcaggcacaaggtgtacaaacatttattttaggtgatgatcgcggaaaaatatatcgccatttaagtgcatctctagcgacgtctaaacagaaaggggatgaaggctaatgcgtaaagttcaacctgttattgaacaattaaaagcacaatctcatccagtttgtcattanatctatgatttagtcggactgggacatcatttgcancatattacatcgnccttgccgagtaattgtcaaatgtactatgcaatg

SEQ ID NO: 3858 - DNA, 400 bp; double-stranded, linear
gcatgaagcccccctcaagatgagatttcccaacttcggttataagatccctcaaagatgatgaggttaataggttcgaggtggaagcatggtgacatgtggaagctgacgaatactaatcgatcgaagacttaatcaaaataaatgttttgcgacaattcacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcaaaaaatggatgccgatggagccgcattgagaccgcaggnctntttgttttttatgtctaaaacgtccaaattaana

SEQ ID NO: 3859 - DNA, 573 bp; double-stranded, linear
gtttattaatcgtgtcattagcatctttataattgcttctaatcgtattcaaatcacctaatgttaaatctgttttaacattattttgaatttcattcatgcatctgaatctgaatcgctatctgaatctgagtcgttgtctgagtccgantcgctatctgantctgagtcgctgtctgaatctgaatcgctatccgagtctgagtcgctatctgagtctgagtcgctatctgaatctgaatcgctgtctgagtctgaatcgctatctgagtctgaatcgctgtccgaatctgagtcgctatctgaatctgaatcgctatctgaatctgagtcgttgtctgagtccgaatcgctatctgaatctgagtcgctatctgagtctgagtcgctatctgaatctgagtcgctgtctgaatctgaatcactgtctgagtctgagtcgctgtctgaagtctgaatcgctgtcagaatctgagtcgccaactgagtctgaatctgaatcactggtctgagtccgaatcgcnatctgaatcngaatcgcnaaccgagtccgaagccgcnaatccgaatctg

SEQ ID NO: 3860 - DNA, 400 bp; double-stranded, linear
gagctacaccgccttatatagtttgtaaataatatggtggagactagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgnaaaatggtgccgaggnaccgggaatcggaaccggtacggttgatncactcaccggcaggatttttaagtcctgtgcgtctgccagttccgccaccccgngc

SEQ ID NO: 3861 - DNA, 400 bp; double-stranded, linear
tgttgcgactaaaccattacctatcgcacatatgacgaaaccaatgataactgcaatgacatattgtgatgccaataattgagtcatgctaataatagtgatgccgatgacagggaacaacggaccaatgatgagcatcaatttgccaccgaaacgtaatgttgctttttcacctaaacgaatcatcgcaactgccacaatggcatatggcaatgtaacangtccagattgcgcactgataaaccaaggtgtgtttgagcatatatgaaaaagaccactgttacgcctagaccgctatttaaaacaaagttatttaaaaatgcaccaatggaacggacggttgcgtaatactggagaantcaataaaaggtacttccatgtccgacgttccgatggatgg

SEQ ID NO: 3862 - DNA, 400 bp; double-stranded, linear
gtgcgcatgggaactatcaagctttgaagatgtggtactacatgcgttgaattagggatcggtactttatatgaagacgtgctgcttccattaaatgagtgatgcgattttggcatgaaggtcaccttaaatgtacattgttgtaataaaattgcctataaatttttagcacataaaataagaggagccaaccattgttagactataacaacggttggctctttaattgtaaaaagaaaaccatacgctatgcgtatggttcagaaaaggtctaccattgtcaccaaaaatgcatctctacgtgctagaataaatattggtcagccaaccaaaataatccacacggggagatgctatttaatgtcctcctgacaccaacagttagcaccatacaaaatgg

SEQ ID NO: 3863 - DNA, 400 bp; double-stranded, linear
tcggcaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaaatgcggctcatcgcatncattnttgccggcaacgttctactct

SEQ ID NO: 3864 - DNA, 400 bp; double-stranded, linear
gtactatagaattaaagaattataaaaatataatcctgattagcttgttgtcaagtcatcgttcataatgaagatatcacgttcaattgtattgtttgtttatgggaaatgaattaatgtaatagtatatgtatgcggttacataaaaagcgaacatctaacctgatatttaaatgaacctgacgctcaatcaactaatttacaaccgtatttttataatcaaccataaaggaggagatagaaaatgaatagtgcaaaattgattgatcacactttattgaagcctgagtcaacacgtacgcaaatcgatccaaatcatcgatgaagcgaagcataccattttaaatctgtatgtgtgaatccaacgcatgttaaangtgccagcagagcgactagctgg

SEQ ID NO: 3865 - DNA, 400 bp; double-stranded, linear
gcagcacgtcttcatataaagtaccgatccctaattcaacgcatgtagtaccacatcttcaaagcttgatagttcccatgcgcacaccacgtttcatactagctatgcgagctcaacttggttcataaactctttaatataagtcaatgtttcaaccatcgctggtggtcttggcacatgtccttctgccatttgataaaatgtttcatgcgtggcaccttttaactctagttggtccgctaaataatacgcatgatgaataccaacttgctggtctttccctccatgtacaattaatattggcggactgttttcattaatgtttggaatcgcttggcgtgcctcatatgccgctcgatcttttttcggatgaccaatcattcttcgtagcatgcctctt

SEQ ID NO: 3866 - DNA, 400 bp; double-stranded, linear
aagtcaataactttttttatcttgtccattttattttttaaccaaaatttgattaaaaaactgcctggcaacgttctactctagcggaacgtaagttcganctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcggaacctattaacctcatcatctttggaggggatcttataaccggaggttggggnaaatctcatcttgagggggggcttccaggcttag

SEQ ID NO: 3867 - DNA, 400 bp; double-stranded, linear
cacctataatcgttttaatcgatggggggacgcatagggataggcgangtgncgattggattgcacgtctaagcagtaaggctgagtattaggcaaatccggtactcgttaaggctgagctgtgatggggagaagacattgtgtcttcgaggtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggaagaagggtgctctttaaggttaacgcccagaagagccgcatgaataggcccaagcgactgtttantcaaaacacagtctctgctaaacctaaggatgta

SEQ ID NO: 3868 - DNA, 383 bp; double-stranded, linear
ttctttggaaatagtaacgttgaagttgtactcactggtgatacatttgatcactgtttagctgaagctttaacttatacaagtgaacatcaaatganctttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgnaaattataggtgttgaaccttcaggtgccaagtagtatgtgatggaatctgttgtgaaatattcaggtagtcacattgccctaantcgataaatttgtggacggtg

SEQ ID NO: 3869 - DNA, 400 bp; double-stranded, linear
ctaagcttaagggttgcgctcgttgcgggacttaacccaacatctcacgacacgagctgacgacaaccaccacctgtcactttgtcccccgaagaagngctctatctctagattgtcaaaggatgtcaagatttggtaaggttcttcgcgttgcttcgaattaaaccacatgctccaccgnttgtgcggttccccgtcaattcctttgagtttcaaccttgcggtcgtactccccaggcggagtgcttaatgcgttantgccagcactaaggggcggaaaccccctaacacttagcactcatcgtttacggcgtggactaccagggtatctaatcctgtttgatccccacggtttcgcacatcagcgtcatttacagaccagaaagtcgncttcggcaat

SEQ ID NO: 3870 - DNA, 377 bp; double-stranded, linear
actaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacatgagcgattatttcttatgaattcaagcttatttaaaactctttattcactcggttttgcttggtaaaagcnngn

SEQ ID NO: 3871 - DNA, 400 bp; double-stranded, linear
ataacgttgcccctcccatgtatatcctacccaaacatgaccatcttgtaacatcacttctgtataatcacaatacccaccaggttggaactgataacccactggacaagataagaatggccccacttttcttactgtgattggttgattgccgtttgtgaatctagcactttcttccatgtagtaagtaccatatttattacgtttccatgcacttgcaactggtttaactgtattacttgaagcgcttgactcattagagacagtggcaaccggtattttaccatccatgtacgccctaaatctgcttgataaagtagtcttttaagttgcaaccgcttgtcttctgggcaatagaccgcgagttacnggggtccaaacccntggtgtaaaancgaac

SEQ ID NO: 3872 - DNA, 400 bp; double-stranded, linear
cgctacactacgagaccattagtaaaacgcaggaagagggattcgaacccccgcgagccgttaagcccctgtcggttttcaagaccgatcccttcagccggacttgggtattcctccaaaattatatggaccttgcaggactcgaacctgcgaccgaacgttatgagccgttagctctaaccaactgagctaaaggtcctaaatataattttacaactaataaatagtggcggtggaggggatcgaacccccgacctcacgggtgatgaaccgtacgctctagccagctgnagctacaccgccttatatagtttgtaaataatatggtggagactagcggggatcgaaccgctgtacctcctgcgtgcaaacgggcgctcttcccagctgnagctaaagc

SEQ ID NO: 3873 - DNA, 584 bp; double-stranded, linear
acagctcacggtctcaacttgcctggcaacgttctactctagcggaacgtaagttggctaccatcgtcgctaaagacctttcttgacttgtgacaatcgcttgcttctttcctctcttcggtctcgcttactcatttagctctactaaactcgttgcgctctttctcgtttcgtcagattcaanngttttcattcgccaagccatttttctttgtgtttactttttattttgacgttttaggcataaaaaaaagagaccttgcggtctcaantgcggctcatcgcatccattttttgcctggcaacgttctactctagcggaantaagttgggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttacttntnattttgacgttttagacataaaaaaaagagaccttgcggtccaaatgcgggctcatcgcatccattttttgcctgggc

SEQ ID NO: 3874 - DNA, 400 bp; double-stranded, linear
tttgcctggcaacgttctactctagcggaacgtaanttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagttgggctaccatcgacgctaagaacctttcttgactgtgacaatcgcttgcttctttcctcttcttcggctctcgcttactcatt

SEQ ID NO: 3875 - DNA, 400 bp; double-stranded, linear
tctgctaatttaaaaatgatattttctatcttttctttattattaacgtctaatgcactggtcgattcatctaataaaagaatatccggtgtatacatcagttggcgcgctatagcaattctttgccgctcaccacccgacatattttccacttccgaacttaattgataatgtcccaaaccgacatctttaattaattgctttgcacgttttctatcaaatttatcattacgtgcaagtgatgggaatatcatgttatcttcaatcggtcaccaaacaagtcactttgctgcatcaaataactgattcgttgacgccaattcttccggggcataatncatataggggttaccttaaaaataaaggtcctccactagttggcctanacnaattacataan

SEQ ID NO: 3876 - DNA, 400 bp; double-stranded, linear
agatagactttctggtgaagatacacgtgaaggtatgacagcaattatatctatcaaacatggtgatcctcaattcgaaggtcaaacgaagacaaaattaggtaattctgaagtgcgtcaagttgtagataaattattctcagagcactttgaacgatttttatatgaaaatccacaagtcgcacgtacagtggttgaaaaaggtattatggcggcactgcacgtnttgctgcgaaaaaagcgcgtgaagtaacacgtccgtaaatcagcgttagatgtagcaagccttccaggtaaattagccgattgctctagtaaaagtcctgaagaatgtgagatttcttagtcgaaggggctctgccggggggtctacaaaatctggtcgtgactctagaccgca

SEQ ID NO: 3877 - DNA, 400 bp; double-stranded, linear
accaatttctcctttgtatccgccatctttaaataattttactgctctagcatgagccaccatcatgttatgtgattggaatactttttcaaaatcatatttaatacctggagggaatttacctactaaatattgaccatcaccaataggtccaatttcattgaatgtagtccaatattttacttctgggaattctttaaaacaatattcagcataatctacaaagtagtcaatcgttttacgntttagaaaatcgccatctttggtggtacacttctgggngtatcaaaatgntgcaatgttacaaatggttcaacatgacggtttatggncactctgcaaataaccttatggtaatactcaacaccttaggggttaacttcggccatatcccttttgg

SEQ ID NO: 3878 - DNA, 400 bp; double-stranded, linear
attaaagcagtttctggatctggtaaaaatggtcgtattacaaaagaagatgtagatgcatacttaaatggtggtgcaccaacagcttcaaatgaatcagctgcttcactaacaagtgaagaagttgctgaaactcctgcagcacctgcngcagttaacattagaaggcgacttcccagaaacaactggaaaaaatccctggctatgcgtagagcaattgcganaacatgggtttaactctaagcatactgcacctcatgtaacattaatggatgaaattggatgttcaagcattatggggatcaccgtaagaaatttaaagaaatcgcggctgaacaaggtactaagttaacattcttaccttatgttgttaangcactgttttcggcatggnaaaaat

SEQ ID NO: 3879 - DNA, 400 bp; double-stranded, linear
ttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgtttcacttcgcaagccatttttctttgtgttgcntttatttgacgtttagacataaaanaaganccttgcggnctcaatgcggccat

SEQ ID NO: 3880 - DNA, 400 bp; double-stranded, linear
taggtgtaaatcctgcgattcgatctggaccatatttttttattgtatacagtaattgtgctgcgattatctctgtaacgtctttccaatttgaacgcacgtgccctcccatacctcgggcttgcttatattgtttggctttgtcttcattttcaacaatagacgcccatgcagcaacgcgattaccattgttttcttctaatgcttcagtccataaatcccagagttttccacgaatatatggatattgattcgaagcggactgtatcataccaagagaatgacgcactcgtggacatcctctcggtcatattcaggcatatccggacacaacttggatagcagttgtgatttcccaggaatcacaccatttcacaaacttccagacatggctgacagt

SEQ ID NO: 3881 - DNA, 400 bp; double-stranded, linear
tgagtagcgaaagacgggtgagaatcccgtccaccgattgactaaggtttccagaggaaggctcgtccgctctgggttagtcgggtcctaagctgaggccgacagngtaggcgatggataacaggttgatattcctgtaccacctataatcgttttaatcgatggggggacgcagtaggataggcgaacgtgcgattggattgcacgtctaagcagtaaggctgagtattaggcaaatccggtactcgttaaggctgagctgtgatggggagaagacattgtgtcttcgagtcgttgatttcacactgccgagaaaagcctctaagataagaaaattaggtgcccgtaccgcaaaccgacacaggtagtccaagatggagantctnaaggtggagcgagc

SEQ ID NO: 3882 - DNA, 609 bp; double-stranded, linear
catccccaacttgcacattattgtaagctgacttttcgtcacttctgtgttggggccctcaccccaactcgcattgcctgtagaatttcttttcgaaattctctgtgttggggcccctgactagaattgaaaaaagcttgttacaagcgcattttcgttcagtcaactactgccaatataacttcgtagagcatagaatattgatttatgtcccagcctgagttaattttctataaaagtatatttaatttgcgtttataccgtcaaacttcactttagctttgtcaaacccctttctattaagttttcagaaataaacctatcttaaaatataaaaaaatcgagaattcgtagtttaataacgaaattctcgttcttatccttttgaatatactcaattttccacaaaaacaaacaagtagtatatctgttctagctactagaatgacatactacttgttattaaaatacttaactaaactttattagttatctttnttctctatatttctacgtggactgacgcttttcangaatgtcagattcataatcttcttggttggactcctggatatattcttggtaagcggatggtttattcggagtcaa

SEQ ID NO: 3883 - DNA, 394 bp; double-stranded, linear
atatattggcggacataacgatgtactagcaggtgtcgtaaccgtcaaagatgaatcactcgcgcaacagttgtttgattttcacaacatgactggcgcaacactttcaccaatagatagttatttgttgttacgtggacttaaaactttgcatttacgcattgagcgtgcgcaatcaaacgctagaaaacttgctaaaaaatgtcagtcacttcaagcaattgacgaatactatatagcgggcaaactggcatgcttagtttaagacttaacaaggcctatagcgtcgctaaattattagaaaatttagacatttgcatttttgcagaaagtttaggaggtackgaaacattagtgaccttcccttacacccaaacactgttgatatgccagt

SEQ ID NO: 3884 - DNA, 400 bp; double-stranded, linear
cgattaatgaattaacagaatacggaccagaaacgataacaccaggtcatcgagacgaatttgatccgaagttaccaacaggagagaaagaggaagttccaggtaaaccaggaattaagaatccagaaacaggagacgtgttagaccaccggtcgattagcgtaacaaaatatggacctgtaaaaggagactcgattgtagaaaaagaagaaattccattcaagaaagaacgtaaatttaatcctgatttagcaccagggacagaaaaagtaacaagagaaggacaaaaaggtgagaagacaataacgacgccaacactaaaaantccattaactggagaattattagtaaaggtgatcgaaagaggaatcacaaaagttccntttatgattaacagata

SEQ ID NO: 3885 - DNA, 400 bp; double-stranded, linear
tgagcggattatttcttatgaattcaagcttatttaaaactctttattcactcggttttgcttggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacattcaaaactggaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcccaaaagggtactnccancgggnttcgg

SEQ ID NO: 3886 - DNA, 400 bp; double-stranded, linear
tacggtaggtggcaagcagttatccnggaattattgggcgtaaagcgcgcgtaggggtttttttaagtctgatgtgaaagcccacggctcaaccgtggagggtcattggaaactggaatncttgagtgcagaagaggaaagtggaattccatgtgtagcggtgaaatgcgcagagatatggaggaacaccagtggcgaaggcgactttctggtctgtaactgacgctgatgtgcgaaacgtggggatcaaacaggattagataccctggtagtccacgccgtaaacgatgagtgctaagtgttagggggtttccgcccctttagtgctgcagctaacgcatttaagcactccgcctgggggagttacgaccgcaaagtttggaaactcaaagggaattgg

SEQ ID NO: 3887 - DNA, 400 bp; double-stranded, linear
attttttaattttcatgcaaatttttaagcaccatataatgcctaccaaatttcaataatctttgttgccgtttaaataatgtgaatgtcaataaattctccaaactagtcgaaaataaagggagtnggacataaatccctaaaaaaacagcagtaagataattttcaattagaaaatatcttactgctgttctctatttatacaatacttcgtattgaatggcttcgctttccnagggtgccgtctcagcctcggtcttcgactggcactgctccctcaggagtctcgccattaatactacgtattaacatggaattttacttttacatactttaaaaaataagncactttggccaacttacactaccataggaaccctggtaggaatcccccaaatgn

SEQ ID NO: 3888 - DNA, 400 bp; double-stranded, linear
atacgacaatcacagcaataataattgctttagaaagtcgtgccgaactggaacttacaagtctagttcgaacacacactgatgtgagtggttttatttattttaaacatgaacaatcagataagttactagcattagcaaatattattaaatcaaagggcttcgattcataaaattaaaacaatgattaaaattagacgtgtaaatgttaaattctaaaacggaaataaccaccatcccattaaaccactttnatngttcaatcactatatttcacacagcttcattaataaaacgacttgcttcaacccgcttcaacttcaactggcttcaacttcagcctacttcattcaatnacaaaacgaatccgcttcatccaaaatcanccattctaacgcac

SEQ ID NO: 3889 - DNA, 485 bp; double-stranded, linear
ccatgcnagacgcatacattgtagcttatgggcgttcagcgcagcgaamgaaagcaaggcgcattattccacgaaagacctgatgatgtcgcagccaaagtattacaaggcgtattgaaacgtattgacggaaaattcaataagaatatgattgaagatgtcattgttggtacggcttttccagaaggattacaaggccaaaacattgcacgaacgattgcattgcgtgcgggattatctgacacggtaccgggtcaaacagtgaatcgctactgctcatcaggattacaaaccatcgcgattgcagccaatcaaattatggctggtcaaggagatatacttgtagctggtggcgttgaattgatgagtgccgtaccaatgggtggcaacgagcccacaaacaatccaaccttwacaatatgatgatataggtgcgtccatatncctatgggtttnaantgctggaaaatgttagcctncccaat

SEQ ID NO: 3890 - DNA, 389 bp; double-stranded, linear
aggcagatgctctcccagctgagctaattctccaaaataatgactcctacgggactcgaacccgtgttaccgccgtgaaagggcgtgtcttaaccgcttgaccaaggagccatggctcacaggtaggactcgaacctacgaccgatcggttaacagccgatagctctaccactgagctactgtgggattaatattatgcctggcaacgttctactctagcggaantgaattcggactaccatcgacgctaaggagcttaacttctgtgttcggcatgggaacaggtgtgacctccttgctatagtcaccagacatatgaatgtaatttatacattcaaaactagatagtgaagtaaaagtggttttgcntcgcaaaacatttattttgn

SEQ ID NO: 3891 - DNA, 400 bp; double-stranded, linear
cagatgtttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagctnagatcctaagtctagtgcgtctgccaattccgccacacccgcaaatggtgagccatagaggattcgaacctctgaccctctgattaaaagtcagatgctctaccaactggagctaatggctcttccatggtgccggccagaggacttgaacccccaacctactggatttacaagtcagtttgctctaccaattggagctagggccgggcaatatggtaagaataaattgg

SEQ ID NO: 3892 - DNA, 400 bp; double-stranded, linear
ctctcggtggtcgtgctacaactggtaaaaatgtacatgtaggggctggcgcagtattagcaggtgtgattgaaccccctagtgcttcaccggttataatcgaggatgatgtattaatcggtgcaaatgcagttattttagaaggtgtacgtgttggtaaaggtgctattgttgcagctggcgcgattgtgacacaagatgtaccagctggtgcagttgttgctggtacacctgcaaaagtgattaagcaagcttctgaagtacaagatactaaaaaagagattgtagcagcattaagaaaactgaatgactagtgacgtcaacgtataataatttccaggttgagatacgattatgtctccaccntaatggtntagcattgaataaacttatgnncccc

SEQ ID NO: 3893 - DNA, 400 bp; double-stranded, linear
gaatgtagttgtggtaaatacaaacgtgttcgctacaaaggcatggtctgtgacagatgtggagttgaagtaactaaatctaaagtacgtcgtgaaagaatgggtcacattgaacttgctgctccagtttctcacatttggtatttcaaaggtataccaagtcgtatgggtattattacttgacatgtcaccaagagcattagaagaagttatttactttgcttcttatgtgttgtagatccaggtccaactggtttagaaaagaaaactttattatctgaagctgaattcagagattattatgatgaaatacccaggtcaattcgttgccaaaaatgggtgccagaaggtcattaaaagatttacttgaagnngattgatncttgacgagggaacttna

SEQ ID NO: 3894 - DNA, 485 bp; double-stranded, linear
cacgtgaagttagagatacttcattacgtgtacctcacggcgctggcggtatcgttcttgatgtaaaagtattcaatcgtgaagaaggcgacgatacattatcacctggtgtaaaccaattagtacgtgtatatatcgttcaaaaacgtaaaattcatgttggtgataagatgtgtggtcgacatggtaacaaaggtgtcatttctaagattgttcctgaagaagatatgccttacttaccagatggacgtccgatcgatatcatgttaaatcctcttggtgtaccatctcgtatgaacatcggacaagtattagagctacacttaggtatggctgctaaaaatcttggtattcacgttgcatcaccagtatttgacggtgcaaacgrtgacgatgtatggtcancaattgaagaagctggtatggctcgtgatggtaaaactgtactttatcgatggacgtaccaggtgacccntccgataacc

SEQ ID NO: 3895 - DNA, 507 bp; double-stranded, linear
gaacaacatacctttgtttgttgattcttctccacctgtttcaagtagttcagatttcttagattgtggttttttagttggtgccactgctttaaccttttcattgatttcaataacaggtgttactactttaccttgttccactggtttagaaggctttttaggttcttctttggcaggtggtactggtttaccangttcagctggtacctctggtgttggcggtgttggagtttctggctcactcggcacttctggtgtcggtggtgttggtgtttccggctcacttggtacttctggtgttggtggcgttggtgtttccggctcacttggtacttctggtgtcggtggcgttggtggcacgattggaggtgttgtatcttcttcaatcgtttgttgaccttcattttgggccgcttacttttgggaagtgtatcttcttcaaagtcaacactaatgtggtccaccggaattgataactggggttaaccttaaattggaacctcc

SEQ ID NO: 3896 - DNA, 400 bp; double-stranded, linear
ctagcggaagtaattggctaccatcgtcgctaaagaccttnggngacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtctcaatgcggctcatcgcatccattttttgcctggcaacgttctactctagcggaangtaattgggctaccatcgtcgctaaagacctttcttgacttgtgacaatcgcttgcttctttcctctccttcggctctcgcttactcatttagctctactaaactcgttgcgc

SEQ ID NO: 3897 - DNA, 400 bp; double-stranded, linear
ttgaagaagatcgcgatgactatacaatcaatatcgagtataataccgatttatatcactcagaaacagttcgtcacatgggtaatcaatgtatgattatgattgattatattttgaagcatcaagatacactacaaatttgtgatataccaaacggcacgaggaacttctaaattgggtcaatacgcatgttaacgatcgaatgcttaatgtcccgggaaataaatctatcataagttactttaatgaagttgtctcacgacaaggtaatcatgttgcgctagtcatgaatganttgacaatgacgtatgaaacattacgcaactatgtgggatgccattgcgcacatgctcctatcaaatggtgtgggcaatggtcaacgggttgccttggtgtacag

SEQ ID NO: 3898 - DNA, 400 bp; double-stranded, linear
gaaatcagtattaaagcagttaatccacaagggaaagtggttaatacagttggctctggtgatagtacagttgcaggcatggtggctggaattgcttcaggtttaacgattgaaaaagcattccaacaagcagtcgcatgcggtactgccacggcatttgatgaggacttagcaacacgggacgctatagaaaaaataaaatcacaagttacgattagcgtacttgatggggagtgaaaataatgagagtaacagagttattaacaaaagatacaatagcaatggatttaatggcaaatgacaaaaatggtgttattgatgagttagtaaatcaattagaccaagcaggtaaattaagtgatgtcgcgtcatttaanggaagcgattcaccatcgngatc

SEQ ID NO: 3899 - DNA, 400 bp; double-stranded, linear
tatcaatttcacactcaatgcggctcatcgcattcatttcttgtctagcaacgttctactctagcggaacgtaagttagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaganacctcacggtctcaacttgcctggcaacgttctacttctagcggaacgtaagttggctaccatcgtcgctnaaagacctttcttggacttgtggacaatcggcttggcantctttnctc

SEQ ID NO: 3900 - DNA, 400 bp; double-stranded, linear
tgcacgcgtatctgatggttgctcagttgcatctacccaaggtaaccattccctaagtgaatttcttgaacgattgactaaattgaaaagcgcttctgtgtcatgagcttctaaaatttttaatgttatttgttcattcactttcattccaaacataccatcacatcctcattcatttttcatataattctgtaaattatcattataataacatattaatgttacgcattgtatcttaaatttgttgtccttccccaacttgcattgcttgtagaatttcttttcgaaattctctatgttggggcccgcnaacttgcattgtctgtagaaattacggacccaatttctctaggtggggcccatccccaacttgcacattaatngcaagcngactttccgt

SEQ ID NO: 3901 - DNA, 400 bp; double-stranded, linear
tactgctgttcactttttataatacttctgaatgtcttcacttatacttctagtcacagatttaaataatcaaaagtgcacattattaaaatatcaatttcacactcaatgcggctcatcgcattcatttcttgtctcaacgttctactctagcggaagtaagttagctaccatcctcgctaagaacctttcttgacttgtgacaatcgcttgcttctttcctctccttcggctctcgcttactcatttagctctactaaactcgttgcgctcttttctcgtttcgtcngattcaaacgttttcacttcgccaagccatttttccttggtggtttaccttttaatttggacggtttagacatnaaaaaaggggacctcacgggcccaacttggcctgggc

SEQ ID NO: 3902 - DNA, 400 bp; double-stranded, linear
ttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtctcaatgcggctcatcgcatccattttttgcctgggcaacgttctactctagcgggaacgtaagttgggctaccancggcggctaaagacctttcctggac

SEQ ID NO: 3903 - DNA, 400 bp; double-stranded, linear
ttgttataacgaaaaccattaatagatttttatttggtgatttcaaatcatgagactgggacagaaatgatgttttcataaaaattatttcgttgttccactctcatgatttttttgatgaaacataattacatgattgattgcatcattttgttaaacaagtgattgcaaacctgccatttcacactgaaaatttacataataagtgacgatattttacaagtcatatacaaataacatatattgttaaataattttacctaatcttaacattaaatttacaattataagcgataatctaaatataaagcttatttgaggtgaaataatggaaatgtcggttacagaagtcattttctcctttttaggtgggtttagggaatttccnttacggccttaa

SEQ ID NO: 3904 - DNA, 400 bp; double-stranded, linear
cataagacataatcgctagtgttcgaaagagcactcacaagattaataacgcgtttcctgtaggatggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggaganctgaaacatcttagtacccggaggaagagaaagaaaattcgattcccttagtagcggcgagcgaaacgggaagagcccaaaccancaagcttgcttgttggggttgtagggcactctatacggagttacaa

SEQ ID NO: 3905 - DNA, 399 bp; double-stranded, linear
aactaacattacaacatgcatgtgaacaattaaaaacatattttaagtaggtgaatgaaatggtaaatgaacaaatcattgatatttcaggtccgttaaagggcgaaatagaagtgccgggcgataagtcaatgacacaccgtgcaatcatgttggcgtcgctagctgaaggtgtatctactatatataagccactacttggcgaattcgtcgtacgatggacattttccgactgttaggtgtagaaatcaaagaagatgatgaaaaattagttgtgacttccccaggatatcaatcttttaacacgccacatcaagtnttgtntacaggtaattccgggtacgacaacacgattgatagtttggttaatgggttaagtattgaaagtgttttgtccgg

SEQ ID NO: 3906 - DNA, 377 bp; double-stranded, linear
ttctttaaaaataaacgcctatncgttatcggtggtggtgattcagcagtagaagagggaacattctaaactaaatttgctgacaaagtaacaatcgttcaccgtcgtgatgagttacgtgcacagcgtattttacaagatagagcattcaaaaatgataaaatcgactttatttggagtcatactttgaaatcaattaatgaaaaagacggcaaagtgggttctgtgacattaacgtctacaaaagatggttcagaagaaacacacgaggctgatggtgtattcatctatattggtatgaaccattaacagcgccatttaangcttaggtattacnaatgatgttggttatattgtgacaaaggtggattggccac

SEQ ID NO: 3907 - DNA, 502 bp; double-stranded, linear
aattaggtaattcaaaataatattagcgcgggatggagcagttcggtagctcgtcgggctcataacccgaagtcggtggttcaaatccgcctcccgcaatacatagtttttaatttaataggtctcgtagtgtagcgrttaacacgcctgcctgtcacgcagagatcgcgggttcgattcccgtcgagaccgccattattattaccattacggttcagtagctcagttggtagagcaatggattgaagctccatgtgtcggcagttcgactctgtcctgaaccattcttaattcatggcggttgtggtgaagtggttaacacatcggattgtggttccgacattcgagggttcgatccccttcagccgccccataatcgtttacattagcgggtgtagtttaatggcaaaacctcagccttccaagctgatgttgtgggkttcgrttcccatcamccngytccataatttcnaanaattccaacagtagccgcaagtnggta

SEQ ID NO: 3908 - DNA, 400 bp; double-stranded, linear
aaaaaatgcatctctacgtgctagaataaatattggtcagccaaccaaaataatcaacacgaggagatgctatttaatgtcatctgacacaaacagtttagcacatacaaaatggaattgtaagtatcatattgtctttgcacctaaatacagaagacaagtgatatatggaaaaataaaaaaagatatagggattatattgcgtcaattatgtgaaagaaaaggtgtagagataattgaagcagaggcatgtaaagatcatatccatatgttagttagtataccacccaaacttgggggtatcatcatttgttgggctatttaaaagggaaaaagtagtttaatggatatttggatagacatggctaacttaaagtatagatatgggaaataggaaagt

SEQ ID NO: 3909 - DNA, 400 bp; double-stranded, linear
ggtttaactattgaagaaaatgtgccgacaattaacaagataaaaaatgcggtatattcagcagataaagctttacctaagattaatgactttgcgaataaaattgtatatttgaataaccaccaagcggatttagataaatatgccaatgattttagaaaactaggaaattataaaggtgatattttagatgctcagaaaaaattaaacgagtcaatggtgctattccgcaacttaatgaaaaggctaagttggatattagcttttaaataattatatgccggaaaattggaaaaagcgtttaaattttgcagctggatgacgtgccacgcngttccctaaaattaatccagggcttaacattgcgagtccaggtattggntccaagctaatggggccg

SEQ ID NO: 3910 - DNA, 400 bp; double-stranded, linear
ttacccgatatcgggaaggtatccacgaaggtgaaattgtaaaatggtttgttaaagctggagatactattgaagaagacgatgttttagctgaggtacaaaacgataaatcagtagtagaaatcccatcaccagcatctggtactgtagaagaagttatggtagaagaaggtacagtagctgtagttggtgacgttattgttaaaatcgatgcacctgatgcagaagatatgcaatttaaaggtcatgatgatgattcatcatctaaagaagaacctgcgaaagagggaagcgccacagnagcaagcacctgtagctactccaaactggaagaagtagatggaaaacagactgtttaaagccatgccttccagttacgttaaatacgcacgtggaaaag

SEQ ID NO: 3911 - DNA, 400 bp; double-stranded, linear
cgtgtanctcaagttatgggtcctgtaattgatgttcgatttgaacataacgaattcctaaaattaataacgccttggttattgatgtgcctaaagaagaaggtacaatacaactaacattagaagttgcgctgcaattaggtgacgacgttgttcgtacaattgcgatggattcaactgatggtgtccaaagaggcatggatgtaaaagatacaggcaaagaaattagtgtacctgttggtgacgaaacattaggtcgtgtatttaatgtactaggtgaaacaattgaccttaaagaagaaattagtgattctgttcgccgcgatcctatccatcgttcaagcaccagcattccgatggaacttttcaacagaagttccaaatttttaggnacagggta

SEQ ID NO: 3912 - DNA, 400 bp; double-stranded, linear
ttgtacaagttgaagaaaaatcaacacaaccaaaaggtagaaaattcaaagatttcactagtaaatttaatatagcatcagaagctaaagaaaatgaacctatatcagtcattggttatccaaatcctaatggaaataaactacaaatgtatgaatcaactggtaaagtattatcagtgaatgggaatatagtgtcatcggatgcaattattcagcctggtagctctggttcacctatattaaatagtaaacacgangctattggtgtaatctatgccggtaataagccatcaggtgaaagcaccagagggatttgctgtttatttctctcctgaaattaagaaattccattgcagataatttagataaatnattaagacctangacattcacccaatcc

SEQ ID NO: 3913 - DNA, 400 bp; double-stranded, linear
actcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgnggctcatcgcatccattttttgcctggcaacgttctactctagcggaagtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttggggtttgcnntttgaatttggacgttttagacata

SEQ ID NO: 3914 - DNA, 400 bp; double-stranded, linear
tggaatgagcggatataagcatctttagataatgcaccatcaactaatggatatttatgtccagttggacgccagaaatcataaacgtcttcagtgtaagcaacagcatcttcatttaatgccaaaatgcttggattatgtgcaataaccatcgcaactgngccacaccttgtgttggctcgccgcctgaattcaatccataacgtgctgtatctgtagcaataactaatactttttcattcggtctagttgctaaataatctttagctaattgaattgctggtgttgcagcataacaagcttctttcatttcaaagcagcgtgcaaaaggttggnatacctaataagttgtggaatttgnacagcggctgctttacgaattccaactgctgattccagt

SEQ ID NO: 3915 - DNA, 371 bp; double-stranded, linear
ccttcttataaaactattaatcgtattagagtgaatcctaatactgatgcgttaattgaatctttatttatccagtttcatagtcaatgtttaaagcaaaatcttattgatggtacaaaagtagaagctaatgccaataggtatacatttgtgtggaagaaaagtattcaaaatcacgaatcgaaattgaacganaattcaaaaacattatatcgtgacttagttgaagaaaaaataataccagagataaaagaagatggagatagcgatttaacaatagangaaatagatttaattggtagtcatttagataaagaaatcgaggtttaaatcattctattgagacgngatagtactcaaattagaaacag

SEQ ID NO: 3916 - DNA, 400 bp; double-stranded, linear
accatggacgacggttaggtttatgaatgttattccaaataggttcatctataaaatagctttagttggaaaagatgagaaaaaatataaagatggaccttacgataatatcgatgtatttatcgttttagaagacaataaatatcaattgaaaaaatattctgtcggtggcatcacgaagactaatagtaaaaaagttaatcacaaagtagaattaagcattactaaaaaagataatcaaggtatgatttcacgcgatgtttcagaatacatgattactaaggaagagatttccttgaaagagcttgattttaaattgagaaaacaacttattgaaaaacagatctttacggtaacatgggttcaggacaatcgtattaaatgaaaacgggggaatata

SEQ ID NO: 3917 - DNA, 412 bp; double-stranded, linear
gaggaaattattaaccttncgcatcgtatgggccntgaaggaataacaacctttagacctggagattgagctaaaataccttctaagttatctgcgtgtaattctggtgtgtgtacgccaccaccaaatgggctacgaattgttacaggtgcagttttagtaccgcctgaacggaaacgagtacgtgcaatttgtccagcaatcgcatcaaatacttcgaatacgaaacctaagaattgtacttccataaccggacggaatccttcaactgcaagacccatcgctaaaccaccaatacctgattcagctaaaggtgtatcgaatactctatcttcaccaaattctttttgtagtccttcagtaacacggaaaacaccgccgttaacaccaacgtcttcaccanaatnaaaac

SEQ ID NO: 3918 - DNA, 400 bp; double-stranded, linear
atagattgctgagtgacaatacttcaggantcgcatatgcaggcccaatacccataattttcgggtcaacgcctactgccttaaaaccaacgaatcgtgcaataggtgtcacgccgagttctttcactttatctccagacattaaaactacaaatcctgcaccatcagaaagtggggcagatgttcctgcagtcatagtgccgtcagctttaaatactgtacgtaatttggctaatgcctccatcgtggtgtcagggcgtatnaaattcatcttggtcaaagatatttgtgtgtacttttggtcctgcgtttgtatattcaactgagtttacttgtattgggatnatttcatctttggaaccgaccatcacggtgtgcgttcataggcacgttgatgnac

SEQ ID NO: 3919 - DNA, 400 bp; double-stranded, linear
caagggcaacaaggtggcaacggcaattatttagaacaaattggtcgtaaccttacnaagaagcacgtgacggtttattagatccagtcattggtcgtgataaagaaattcaagaaactgctgaagttttaagtagacgaactaaaaacaatcctatattagttggagaagctggtgttggtaaaactgcgattgttgaaggtttagcacaggcaatcgttgaaggaaatgtaccagcagcaatcaaagacaaagaaattatttctgtagacatttcatcattagaagctggaacgcaatatcgtggtgcttttgaggaaaatattccaaaattaatcgaggtgttaancttcacaaatgccgtactatctttgatgaanccatcaattatcggttcagt

SEQ ID NO: 3920 - DNA, 400 bp; double-stranded, linear
cttatcccgtccacacatagctacccagctatgccgttggcacgacaactggtacaccagaggtatgtccatcccggtcctctcgtactaaggacagctcctctcaaatttcctacgcccacgacggatagggaccgaactgtctcacgacgttctgaacccagctcgcgtaccgctttaatgggcgaacagccaagnccttgggaccgactacagccccaggatgcgatgagccgacatcgaggtgccaaacctccccgtcgatgtgaactcttgggggagataagcctgttatccccggggtagcttttatccgttgagcgatggcccttccatgcgggaancaacggattcactaaagtccgtcttttcgaacctggctcggacttgtaggtctcgg

SEQ ID NO: 3921 - DNA, 400 bp; double-stranded, linear
cgggttgggcaggtatgttgtattaccgttcacagcagcatcactttgaacaacatttgttaacggattatttggcaattcggttagttgtcgaacaattgctagttggtgatgagtttaagtcagtcgctaaagattgtgaaagtagatcggaaaattggtttaagcaaactgttgcatcatggtgttactacagtggatatgcctagcgatgtattactacaacatgacgtcaatgaaattcaaacgtttattcattttggcagcaactatggaataaaaatgtatttaaaatttatggctnaattgccnggggaaatgacatacgggatctcagtttaaaacaaaaattaaagcaggtcatggaaagtgtggcgggcgccttaggtgtnaacccagt

SEQ ID NO: 3922 - DNA, 400 bp; double-stranded, linear
gtgcgctctaaccagctgagctataggcccatttttttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgtatctacgtttactagcgattccagcttcatgtagtcgagttgcagactacaatncgaactgaggaacaacttttatggggtttgntttgn

SEQ ID NO: 3923 - DNA, 400 bp; double-stranded, linear
agtaagtaaaatatagattttaccaagcaaaaccgagtgaataaagagttttaaataagcttgaattcataagaaataatcgctagtgttcgaagaactccacaagattaataacgcgtttcctgtaggatggaaacatagattaagttattaagggcgcacggtggatgccttggcactagaagccgatgaaggacgttactaacgacgatatgctttggggagctgtaagtaagctttgatccagagatttccgaatggggaaacccagcatgagttatgtcatgttatcgatatgtgaatacatagcatatcagaaggcacacccggagaactgaaacatcttagtacccggagaagagaaagaaattcgntccctagtaccgcgancgaaacggga

SEQ ID NO: 3924 - DNA, 400 bp; double-stranded, linear
atgcgatacgtagcacagctgcaacaatccatgctagtaaaatcggagacatctctgtaccttcaaactagcaattgtatttccgacaccgccgtcaattaatacttgtttaatgtaccgccaccgccaataatcaataacatcattccgattggataaatcgcattcgtcactgattccataatatgattcatcttacgctttctcattaatcccatcgtaacggttgcaaataatactgctattagcatggctgtccctgctgttcctatcatataaatgatagattcaaatagatttgtagggttgtcatgcccagttacaagttgcgttgatcgtngacactaacattaatatgactggtaatgttgctgttaataaactcataccaantccgggc

SEQ ID NO: 3925 - DNA, 525 bp; double-stranded, linear
ggctgggctagctggattcgaaccaacgagtgacggananaggtccgttgccttaccgcttggctatagcccaatatatagatggtggaggggggcagattcgaactgccgaacccgaagagccggatttacagtccgccgcgtttaccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcgtgtgcttaacccttggaccaaggagccatggctcacaggtaggactcgaacctacgaccgatcggttaacagccgatagctctaccactggagctgactgtggattaatattatgcctggcaacgttctgannctagcggaantgaattcggactgaccatcgacgcnaaggagctgaacttctgtgttcgggcatggggaac

SEQ ID NO: 3926 - DNA, 400 bp; double-stranded, linear
tgttattgttcaaaatcatgatcaagatcagtatatcgttgcttattatgaagcgatgcatacattatcacataataagattaaatcacaattacgtatgaccttaccggagtacatgataccagttaatttcatgcatattgagcaaattcctattactattaatgggaaattagataagaaggcattgcctatcatggactatgtcgatacggatgcctatgtagcaccgagtacagataccgnacacttgctatgccaaatttttgcagatattttacatgtgaatcaagtaggtattcatgataatttctttgaattaggngggccattccattaaaagcaacgttatgggtggaatccggatagaggcatccactggggaacggttaccaattgg

SEQ ID NO: 3927 - DNA, 400 bp; double-stranded, linear
tatcgatcaatttctatcgagttggacaatgccgaacgtgacaaagtttttaccatgcatggttgcatttagcgcaacatgaccatagttttactaaagcacagcgcgcaagtgattaaaggcttacccaatgatcctgaaatgacgatagagtcagtattaactcatttttcaatagatcaggaagactaccaagcttatgttgaaggacatcttttggcgttaccgggttgggcaggtatgttgtattaccgttcacaacagcatcactttggaacaacatttgttaacggattatttggcaattcggttagttgtcgaacaattgctagttggtggatgagtttaagtccatcgctaaagatgtggaaatagnccggaaaatggttttaagcaaact

SEQ ID NO: 3928 - DNA, 400 bp; double-stranded, linear
gtgcacctaacgctgaaatatcgccttctcgtgtatagcagacggaatcattttttgtgcantttgttaaatataggccctgcaatgagtgtactggaatggcaataatcataccatacagtaatacatctccaacatttgcctttaattcttttgcgatgactaccggtcctggatgtggtggtaaaaagccatgtgtcactgataaagctgttaccataggtagtcctagttttaacactgaaacatttgcgcgttttgctactgtaaatactaatggaatcagtaagactaaacctacttcaaagaacaatgcaataccgacgataaatgctggcaacaagcattgccccattggtacatggtttttggaccaaatttttggaatcaacgtgtctgg

SEQ ID NO: 3929 - DNA, 400 bp; double-stranded, linear
ctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaangtctgacaatgttaactttgcattatctatttgccgcaattggtggtggcggtttaatttcaggtatttcgtacttactnttaaaacctattcacctaccacgnaaattataggtgttgaaccccnagt

SEQ ID NO: 3930 - DNA, 374 bp; double-stranded, linear
atatgatcctatgaagcaattttatgtagtaagtggttctaaacatgacgcccttatgctctgtgaacatttatatgacgaggttatggctgtttgctaancccaaatgatacatcgaatggcacatatcattcgtcgcaatatgattactatgatgcatttattaagcagcaagaaaatgtaacatatatttcaaccgatcgtgcagatgctaatacagtgttatgtcactaatttataaaaaataaatgaataagtaaggtttcaaccgagagaatatattcgtgttgaagccttatttgtcgttgtgccaaatttgaacgntttagatggcaataagcatgaccatacagattgtgtattatttccatgna

SEQ ID NO: 3931 - DNA, 387 bp; double-stranded, linear
acctgtgcggtcatccgtaccatccacataattaaaggctctacgtaaaattgacgtatttgcttctttcgctagcctcgtatgggcatctttatcaataatatactcgccatgactatctttcgcttttaagtcaatttcatcaaactctttcccacctgttaacggtgcaccactatgtcgtttccgaccaaatgtagcctcttgttcttccagcgcagtacgatcccacgtttcaatgtgtatttgaatacgtctgacaacgcaataagttccatgtttcgcccatccgtcatcaataaacacataatctttaagttgattattcttcctaggattaattgttccactttaaaatgccattnaaattctaggtgtttccntanc

SEQ ID NO: 3932 - DNA, 400 bp; double-stranded, linear
aaggtaataatcctgtagtcgaaaatgttgtctctcttgagtggatcctgagtacgacggagcacgtgaaattccgtcggaatctgggaggaccatctcctaaggctaaatactctctagtgaccgatagtgaaccagtaccgtgaggagaaggtgaaaagcaccccggaaggtagntgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcngaagnangttctgaatagggcgtttagtatttggtcgtagccgataaccaggtgattctaccctttggtcaggttgaagttcaagtaacat

SEQ ID NO: 3933 - DNA, 400 bp; double-stranded, linear
gcgatggttgaaacattgacttatattaaagagtttatgaaccaagttgagtcgcatagctagtatgaaacgtggtgtgcgcatgggaactatcaagctttgaagatgtggtactacatgcgttgaattagggatcggtactttatatgaagacgtgctgcttccattaaatgagtgatgcgattttggcatgaaggtcaccttaaatgtacattgttgtaataaaattgcctataaatttttagcacataaaataagaggngccaaccattgttagactataacaacggttggctctttaattgtaaaaagaaaaccatacgctatgtgntgccaaggaaaaggttctaccattgtcacnaaaaatgcatctctacgtgctaggaataaatattgggtc

SEQ ID NO: 3934 - DNA, 400 bp; double-stranded, linear
tttgacgttttagacataaaaaaagagaccttgcggtccagatggggctcatcgcatccactttttgcctggcaacgttctactctagcggaantaatcgaactaccatcgacgctaaggagcttaacttctgtgttcggcatgggaacaggtgtgacctccttgctatagtcaccagacatatgaatgtaaattatacattcaaaactagatagtaagtaaaagtgattttgcttcgcaaacatttattttgattaagtcttcgatcgattagtattcgtcagctccacatgtcaccatggcttccacctcgaacctattaacctcatcatctttganggatcttataaccgaattgggaanctcatctgaagggggctcagctagatgcttcanactt

SEQ ID NO: 3935 - DNA, 393 bp; double-stranded, linear
tgttctttttgggcagtgggacacaaatggatattttcggcaaaatttatttcgttcgntcccaccccaacttggcacactattgtaagctgacttttcgccagcttctgtgttggggccccgccaacttgccattgtctgtagaaattgaggagctaatttctctgtgtcggggctccaccccaacttgcacactattgtaagctgactttccgccagcctctgtgttggggccccgccaacttgcacactattgtaagctgactttccaccagcctctgtgttgggccccgactatttttgaaaagagcgtgttacacgggcattgttttacagtcaactactgctaaaataaaattaacgagcttaaggctttggnttctgtcccaagcc

SEQ ID NO: 3936 - DNA, 400 bp; double-stranded, linear
aaaaagaagacaaccaagcccaataatggactggccgcgtaataatngtggctctaaaagttgtattttaaaaatagttctttaaattatatacccaccacatttggtggagaacctaaaaaaaagcacttcccaaaaatggaaagtgcaagtagtgagccatagaggattcgaacctctgaccctctgattaaaagtcagatgctctaccaactgagctaatggctctaatggctgggctagctggattcgaaccaacgagtgacggantcaaaagtccgttgccttaccgcttggctatagcccaatatatagatggtggaagggggcagatcgaactgccgaacccgaggagcggatttacagtccgccgcgtttagcacttcgctaccctccagct

SEQ ID NO: 3937 - DNA, 609 bp; double-stranded, linear
ggtttaacacgcctgcctgtcacgcaggagatcgcgggttcgattccctgtcgagaccgccattattattaccattacggttcagtagctcagttggtagagcaatggattgaagctccatgtgtcggcagttcgactctgtcctgaaccattcttaattcatggcggttgtggtgaagtggttaacacatcggattgtggttccgacattcgagggttcgatccccttcagccgccccataatcgtttacattagcgggtgtagtttaatggcaaaacctcagccttccaagctgatgttgtgggttcgattcccatcacccgctccattattttctattattccacagtagctcagtggtagagctatcggctgttaaccgatcggtcgtaggttcgagtcctacctgtggagccatggctcyttggtcaagcggttaagacaccgccctttcacggcggtaacacgggttcgagtcccgtagagtycatacaagcagaagtgnaaatatcgcttctgtttttttattacatawttaatkgttggaggaagttgtccgagcygggccgaaggagcacgcctggaaatgtgtaagcgttcacaagctt

SEQ ID NO: 3938 - DNA, 400 bp; double-stranded, linear
taaagttgttctcagttcggattgtagtctgcaactcgactacatgaagctggaatcgctagtaatcgtagtcagcatgctacggtgaatacgttcccgggtcttgtacacaccgcccgtcacaccacgagagtttgtaacacccgaagccggtggagtaaccttttaggagctagccgtcgaagtgggacaaatgattggggtgaagtcgtaacaaggtagccgtatcggaaggtgcggctggatcacctcctttctaaggatatattcggaacatcttcttcagaagagcggaataacgtgacatattgtattcagttttgaatgtttgttcattcaaattaatgggcctatagctcagnggttanagcgcaccctgatnaacgtgaagtcggtggtt

SEQ ID NO: 3939 - DNA, 400 bp; double-stranded, linear
agttttgaatgtataaattacattcatatgtctggtgactatagcaaggaggtccacctgttcccatgccgaacacagaagttaagctccttagcgtcgatggtagtcgaacttacgttccgctagagtagaacgttgccaggcataatattaatccacagtagctcagtggtagagctatcggctgttaaccgatcggtcgtaggttcgagtcctacctgtggagccatggctcttggtcaagcggttaaggacaccgccctttcacggcggtaacacgggttcgagtcccgtagagttcattattttggagaattagctcagtagggagagcatctgccttacaagcagagggtcggcggtttcgaaccctncattttccaccatttggttattaaan

SEQ ID NO: 3940 - DNA, 400 bp; double-stranded, linear
acacaacagctgtttcaaaaatgattggtacaactgctggttatgttggttatgatgacaattcaaatacgttaactgaaaaagtacgccgtaatccatactcagtcattctatttgatgaaatcgaaaaagcaaatccacaaattttaacattgttattacaagtaatggatgatggtaatttgactgatggtcaaggtaatgtcatcaactttaaaaatacaattattatttgtacatcaaatgctggctttggcaatggcaatgacgctgaagaaaaagatattatgcacgaaatgaaaaaattcttccgccctgaattccttaaccgcttcaacggcatcgtgaattncttacatttagataaggtgccntgcaggtatcgtccaactattattag

SEQ ID NO: 3941 - DNA, 400 bp; double-stranded, linear
atacaattttaaatctgtatgtgtgaatccaacacatgttaaatatgcagcagagcgnctagctgattcagaggtgctcgtttgtacggtaataggattcccattaggtgcgtcgacaactgcaacgaaagcatttgaaacagaagatgcaattcaaaatggtgcagatgaaattgacatggtcatcaacatcggcgcattaaaagatggacgttttgatgatgtacaacaagacattgaagcagtggttaaagctgcgaaaggtcacacagtaaaagtgattattgagacggtattgttggaccatgacgaaattgtaaaagcgagtgattaacaaaagcggctggtgcggacttcgttaaaaacttcagcaggttttgccagtggcngtgcgactgca

SEQ ID NO: 3942 - DNA, 400 bp; double-stranded, linear
ctctggatcaaagcttacttacagctccccaaagcatatcgtcgttagtaacgtccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatattttacttactnatctagttttcaatgtacaaataatggtggagactagcgggatccgaacccgctgacccnaccngcgtgcaaagcaggcgctctacccagcttgagctaagg

SEQ ID NO: 3943 - DNA, 400 bp; double-stranded, linear
cgctacactacgagaccattagtaaaacggaggaagagggattcgaacccccgcgagccgttaagcccctgtcggttttcaagaccgatcccttcagccggacttgggtattcctccaaaattatatggaccttgcaggactcgaacctgcgaccgaacggttatggagccgttagctctgaaccaactgagctaaaggtcctaaatataattttacaactaataaatagtggcggtggaggggatcgaacccccgacctcacgggtatgaaccgtacgctctagccagctgagctacaccgccttatatagtttgtaaatnannatggtgggagactagcggggttcgaaccgctggacctcctgcgtgccaaagcaggcggcttctacccagctggag

SEQ ID NO: 3944 - DNA, 406 bp; double-stranded, linear
ccaaaattgcaccttgtcgtttattcggaaaatcaatatngntagggggtataagatgcacctactttaactgtcgccaacatcgccgcaatcatttcaaaactacgttctgtaaacaaggcaacccgttgaccattgcccacaccatttgataggagcatgtgcgcaatggcatccacatagttgcgtaatgtttcatacgtcattgtcaaatcattcatgactagcgcaacatgattaccttgtcgtgagaaacttcattaaagtaacttatgatagatttatttcccgggacattaagcattcgatcgttaacatgcgtattgacccaatttagaagttcctccgtgccgtttggtatatcacaaatttgtagtgtawcttgatgcttcmaaatatcaatcan

SEQ ID NO: 3945 - DNA, 400 bp; double-stranded, linear
caatgacaacagcaactgagacagtgtcaaacgcttaataataatgatgtagtgtcgaataataccgcattaaatgtaccaactaaaacaaatgaaaatggttcaggaggacatctaactttaaaggaaattcaagaagatgttcgtcattcttcaaataaaccagagctagttgcaattgctggaaccagcatctgaatagaccgaaaaagagaagttagacgtgcggcaccggcagatcctgaatgccaactccagcagatccagcggctgcagcggttaggaaacggtggtgcaccagttgcaattacagcgccatatacgccaacaactgatcctaatgccatgangccaggacaaatggcacctaacgangcttgttcatttgatggacanggta

SEQ ID NO: 3946 - DNA, 400 bp; double-stranded, linear
ctcgctgcgataaagtaccagttcatagcaacgtttgtnttaataggntctgaaacgatacgtgttgccggttctgtaaatgaatagaccaaagcatcttgcataccaacaactatatttgctgcaaatcctccaacagcggaanatatgccatcgttagtccagcgatagggtgatagccaattttaataaaaagcattgctgcaacggccggcaagataattgtcgcagcatcgccggctgtactacctaaaataccaattaatataatagtcggtaaaattaagaaacgtggtgcgcgattcacaacagaaatcattaacttatcgaagtatcctgttttctctgcaacaccaataccaatcatcactgctaggtactaagcctaatgctgggnact

SEQ ID NO: 3947 - DNA, 361 bp; double-stranded, linear
gccggccagaggacttggaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaantaattcgnactaccatcgacgctaaggagcttaacttctgtgttcggcatgggaacaggtgtgacctccttgctatagtcaccagacatatgaatgtaatttatacattcaaaactagatagtaagtaaaagtgattttgcnttcgcaaaacattta

SEQ ID NO: 3948 - DNA, 382 bp; double-stranded, linear
ttccgtcagaccctgacatggttcatgggttcatattgcataggaccgaaatcttcaaacactacgtgctttgggcagacttcgcaaaaatacggcctcaacaaaggaattaagcctcgcataaagcggatttcgagtacagggaaccgctacctccccacctagcacggcaagatatatattactatattttaatagttaattgcaagtataaatcatttatatcattgtttactttatacgacgtcttgagaagtcattaatttaaattcatttgcaagatgttttgaaatattatattgaaacggcattgtattttctaaatacacantacttcgaactgttgcngaataggccaccgatacatcaccaacaattggna

SEQ ID NO: 3949 - DNA, 400 bp; double-stranded, linear
gccaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttantttgacgttttagacataaaaaaaagagaccttgcggnctcaatgngggctcatcgcatccaatttttggcctggcaacggttctact

SEQ ID NO: 3950 - DNA, 389 bp; double-stranded, linear
actcggttttgcttggaaaatctatatttacttacttatctagttttcaatgtacaatttctttttagtcaagcgctcgcatactgctttattttcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggntacnccaccggcttcgggtgttacaaactctcgtggtgtgacgggcggtgtgtacaagacccgggaacgnattcaccg

SEQ ID NO: 3951 - DNA, 377 bp; double-stranded, linear
aaagctcgacttgtttacgatgttgaaaaacaagattatgtacctgtatcgcaaccacaattaccaattttaaatgaatttaataaagacttagtgcataaccttgataccatattcaatgcgcaagacgancgggactatttttatgggagacattacgtaataatttctattactctgctatcaatgtacctaaagctaccgatgatttccgagacatagaccgtgcgcttgtctgggggttcaactggaaacttggtccattccaattatgggatgcaatgggatacgaacgtgttaaaacantgatgggaagacgaacttgggagacttaccacaatgggattagtganttagatggtggctttataaacaag

SEQ ID NO: 3952 - DNA, 400 bp; double-stranded, linear
caaagggcagcgaaaccgcgagtccagagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaagtgggacaaatgattggggtgaagtcgtaacaaggtagccgtatcggaaggtgcggctgggatcacctcctttctgaaggatatattcgggaacatcttcttcagaagagcgggaataacgtgacatattgtattcagntttggaatgtttnnttaacattncaaaaaaatggggcc

SEQ ID NO: 3953 - DNA, 400 bp; double-stranded, linear
tgattttgacgttttagacataaaaaaaagagaccttgcggtctcaaatgcggctcatcgcatccattttttgcctggcaacgttctactctagcggaacgtaattggctaccatcgacgctaagaacctttcttgacttgtgacaatcgcttgcttctttcctcttcttcggctctcgcttactcatttagctctactaaactcgttgcgctcttttctcgtttcgtcagattcaaacgttttcacttcgccaagccatttttctttgtgtttgctttttattttgacgttttagacataaaaaaaagagaccttgcggtctcaatgcgggctcatcgcatccattttttgcctggcaacgttctactcnagcgggaagtgaagncggactgaccaagc

SEQ ID NO: 3954 - DNA, 400 bp; double-stranded, linear
aaactacataatgaaaatgccgttttaatcggtaaattaaatatggatgagtttgcaatgggtggttcaacagaaacatcttatttcaaaaaaacagttaacccatttgaccataaagcagtgccaggtggttcatcaggtggatctgcagcagcagttgcagctggcttagtaccatttagcttaggttcagacacaggtggttcaattagacaaccggctgcatattgtggcgttgtcggtatgaaaccaacatacggtcgtgtatctcgatttggattagtgctttgcatcttcatagaccaaattgggccatgactcgaatgtaaagtaatgccatcgtattagaagctattctggtgcagatgntaatgactctaccagtgcaccagtgatgagg

SEQ ID NO: 3955 - DNA, 400 bp; double-stranded, linear
tcgattggcatttctccgctaccctcagttcatccgctcacttttcaacgtaatcggttcggtcctccattcagtgttacctgaacttcaacctgaccaagggtagatcacctggtttcgggtctacgacaaatactaaacgccctattcagactcgctttcgctacggctccacatttactgcttaaccttgcatcaaatcgtaactcgccggttcattctacaaaaggcacgccatcacccattaacgggctctgactacttgtaagcacacggtttcaggttctatttcactccccttccgggggtgcttttcacttttcncttcaaggtatgggttcactatcggtnactagagagtaattagcttaggngatggtcctcccagattcggaaggga

SEQ ID NO: 3956 - DNA, 400 bp; double-stranded, linear
gctacgggcgcatatgtttttattgaaaatggtgccgaggaccggaatcgaaccggtagtggntncactcaccgcagattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagcttaggatcctaagtctagtgcgtctgccaattccgccacacccgcaaatggtgagccatagaggattcgaacctctggaccctctggattaaaagtcagatgctctaccaactggagctaatggctctttccatggtgccgggccagaggactttgaan

SEQ ID NO: 3957 - DNA, 379 bp; double-stranded, linear
cagacatgtgttatacgggaaattgggcgaaccgcaactattatacattgatttacaccttatacatgaagttacttctcctcaagcatttgaaggacttaggcttcaaaacagaaaattaagacgcccagatttaacatttgcaacactcgatcacaatgttcctactattgatatattcaatattaaagatgaaattgcaaacaaacaaatcacaacattacaaaaaaacgccatagattttggggtgcatatttttgatatgggttctgatgaacaaggtattgttcacatggtaggacctgagacaggacttacacagcctggcnagaccatccgtntgtgggtgactctcacacagccacacatggngcctttt

SEQ ID NO: 3958 - DNA, 400 bp; double-stranded, linear
tgttaaaatacggtacatctaaattaatgttaactgattttcaaaaagagaattaaataaatatattcaaggtcaganacaacgcgtgatatttgaaaatggccattttgtctaattgatagtgaatataattagagtaagaggctgggacataaatccctaaaaaacagcagtaagataattttcaattagaaaatatcttactgctgttctctatttatacaatacttcgtattgaatggcttcgctttcctagggtgccgtctcagcctcggtcttcgactggcactgctccctcaggggtctcgccattaatactacgtattaacatgtaattttactttggaaatactntaaaaaaataagacatttgnccaacttgacactaccattaaaaact

SEQ ID NO: 3959 - DNA, 400 bp; double-stranded, linear
gagccgcagtggaatgaggcccaagcgactgtttatcaaaaacacaggtctctgctaaaccgtaaggatgtgttataggggctgacggctgcccggtgctggaaggttaagaggagtggttagcttctgcgacgtacrgaatcgaagccccagtaaacggcggccgtaactataacggtcctaaggtagcgaaattccttgtcgggtaagttccgacccgcacgaaaggcgtaacgatttgggcactgtctcaacgagagactcggtgaaaatcatagtacctgtgaagatgcaggttacccgcgtacaggacggaaagncccctggagctttactgtagcctgatattgaaatncggcacagtttgtacaggataggttaggagccttggaaacgtgtg

SEQ ID NO: 3960 - DNA, 400 bp; double-stranded, linear
tggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatggtgccgaggaccggaatcgaaccggtagtgantncactcaccgcagattttaagtcctgtgcgtctgccagttccgccaccccggcactataaaaatggagcagaagacgggattcgaacccgcgaccccaaccttggcaagttgttattcttaccgctggaactacttctggcatatgcgggttgaaggggagtcgaacccccacgccgtaggcttaagattcctgaagtctagtgcgtctggccaatttccgg

SEQ ID NO: 3961 - DNA, 400 bp; double-stranded, linear
ttttgatacataatctaaatttctcaaagcgccaataacagaggaccatctcctaaggctaaatactctctagtgaccgatagtgaaccagtaccgtgagggaaaggtgaaaagcaccccggaagggagtgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcgaaagcgangtctgaatagggcgtttagtatttggtcgtagaccggaaaccaggtgatctacccttggtcaggttgaagttcaggtaacactgaatggaggaccgaaccgacttacgttgaaaagtgagcggatgaactg

SEQ ID NO: 3962 - DNA, 361 bp; double-stranded, linear
taataattacagtatatcgggaagacaggattcgaacctncgaccccttggtcccaaaccaagtgctctaccaagctgagctacttcccgtatanttaacgcgcccgataggagtcgaacccataacctcttgatccgtagtcaaacgctctatccaattgagctacgggcgcatatgtgtttattgaaaatggtgccgaggaccggaatcgaaccggtacgtgatcactcaccgcaggattttaagtcctgtgcgtctgccagttccgccaccccggcactatanaaatggatcagaagacgggattcgaacccgcgaccccaaccttggcaaggttgtattctaccgctgaactacttc

SEQ ID NO: 3963 - DNA, 375 bp; double-stranded, linear
cgcgaaatatcattttgaggaattctaacagaagtttttattggtagtgtaagttgggcaaagtgtcttatttttttaaagtatttcaaagtaaaattacatgttaatacgtagattaatggcgagactcctgagggagcagtgccagtcgaagccgtaggctgagacggcaccctaggaaagcgaaccattcaatacgaagatntnatnaaatagagaacagcagtaagatattttctaattgaaaattatcttactgctgttttttagggatttatgtcccagcctcttactctaattatattcactatcaattagacaaaatggccattttcaaatatcacgcgttggtttctgaccttggaatatatttat

SEQ ID NO: 3964 - DNA, 400 bp; double-stranded, linear
aaaatggccttgatagacttgctcaatgcagggttgccacaaaccaatgatgcacttacaattttaaatagatttttaagaccttgttggttttgtacaattaatgtgacatgactaggtcttgcacgtttatatgcatcttcattactgagttttttgttgatttcgttatgatttaatacgcctaattctttcatttgttgaaccatttttatgaaaatgtaagctgttgcttctgtatcataaatggcacggtgatgttgcgttaattctacgccatattttttagccaagaaattcaaaccatgtttaccatattcagtattaatcgtacgaggataattctaaagtatcgataacaccattcgttggatggtccaaacccaagacgttcatatcc

SEQ ID NO: 3965 - DNA, 391 bp; double-stranded, linear
acttttaattttgtcatgatgtgcctccttaccgtatgatgttattcaaagtaaattgctttgcctgattttgcagactgataaatcgcttcaagaatttttgtaactaccattgcttgttccggtttcacaactggttcagtatcatttacaactgcatcaatccaagcttttgcttcttcttcagcttcatccacttcattaccttcataaaagtcgacgcctttgttttccaattcaacgtgtttggtataaagtgtacccatgtcttcaccatgaatacgtagaccatctttcatatcagcacctgctttaggttcctgataatgaacattttggcctcatccacttctaaangaattaatcgcccaagngggattccaaaaaggan

SEQ ID NO: 3966 - DNA, 398 bp; double-stranded, linear
cgctatcaggtattgtttcaacaatttcattaacatatcgtgaaatatcattttgagggattctaacagaagtttctattggtagtgtagttggggcatgttataatttttatacataaggcacctcgttaatttagtttagtggtatttattaaattataagaagggacccaacacagaaaattcattttattgaattttacatttatgtgcaagttgggcaaagtgtcttattttttaaaagtatttcaaagtaaaattacatgttaatacgtatataatggcgagactcctgagggagcagtgccagtcgaagccaaggctgagacggcaccctaggaaagcgacncattcaatacgaagattgtataaatagagaacagcagtaagatattttc

SEQ ID NO: 3967 - DNA, 374 bp; double-stranded, linear
gctatagaaaaaataaaatcacaagttacgattagcgtacttgatggggagtgaaaataatgagagtaacagagttattaacaaaagatacaatagcaatggatttaatggcaaatgacaaaaatggtgttattgatgagttagtaaatcaattagacaaagcaggtaaattaagtgatgtcgcgtcatttaaggaagcgattcacaatcgagaatcacaaagtacaactggtatcggcgaggtattgccattccacatgccaaagtggccgcagttgaagtcaccagctattgcgtttggtaaatctaaagcaggcgtggattatcaantttggntatgcaaccagcacacttnttctttgtggttggcagcg

SEQ ID NO: 3968 - DNA, 400 bp; double-stranded, linear
accccggcactataaaaatggagcagaagacgggattcgaacccgcgaccccaaccttggcaaggttgtattctaccgctgaactacttctgcatatgcgggtgaagggagtcgaacccccacgccgtaanctgaggatcctaagtctagtgcgtctgccaattccgccacacccgcaaatggtgagccatagaggattcgaacctctggaccctctgattaaaagtcagatgctctaccaactgagctgaatggctcttccatggtgccggccagaggacttgaacccccaacctgactggattacaagtcagttgctctaccaattgagctaaggccgggcaatatgtaagaataaatggtggagaatgacgggtttcgaancgccgaccctctgctt

SEQ ID NO: 3969 - DNA, 400 bp; double-stranded, linear
gcgagttggggtgtgggccccaacatagagaaattggattcccaatttctacagacaatgcaagttggcggggccccaacacagaagctgacgaaaagtcattancaataatgtgcaagttggcggggccccaacacagaagctgacgaaaagtcattancaataatgtgcaagttggcggggccccaacacagaagctggcggaaagtcagcttacaataatgtgcaagttggggtgggacaacgataaagtaatactttttctatagaaattagtatttcttatgcatgagttttactcatgtattcctatttttaagtacacattagctgtggctaatgtttaagacccactacataataaatcattagtggctctntatcatttctgtcccactcc

SEQ ID NO: 3970 - DNA, 419 bp; double-stranded, linear
gataagatcagccgaaaatggatggtgttaagagcgttacttggtttggcggtatgcttatttttaatggcattgtgtacgacaccattacagtttgtacttgtgaggttattgcagggactatttggtggtgttgttgatgcatcaagtgcgtttgcgagtgcagaggcgccactgakagatcgtggaaagtattaggagactgcaaattcagtcagcgcaggtctcttgtggggccattaattggcggtgttacagcttcgatattaggttttagtgcgttactgatgagtattgccgttattacttttattgtctgtattttcggtgcattaaaatgattgaaacgacacatatgccaaaatcacaaacaccaaatattaataaaggtnttcgccgttccanttncaatgtctaat

SEQ ID NO: 3971 - DNA, 381 bp; double-stranded, linear
aaacttgggagacttcaataacagatttaggtttatctaaaaatcaggcatataatttcttaattacatctagtcaaagatggggccttaatcaagggataaatgcaaatggctggatgagaactgacttgaaaggttcagagtttacttttacaccagaagcgccaaaaacaataacagaattagaaaaaaaagttgaagagattccattcaagaaagaacgtaaatttaatccggatttagcaccagggacagaaaaagtaacaagagaaggacaaaaaggtgagaagacaataacgacaccaacactaaaaaatccattaactggagtaattattagtaaaggtgaaccnnaaggaggggtttccanagtccgttatg

SEQ ID NO: 3972 - DNA, 400 bp; double-stranded, linear
gggttcagaacgtcgtgagacagttcggtccctatccgtcgtgggcgtaggaaatttgagaggagctgtccttagtacgagaggaccgggatggacatacctctggtgtaccagttgtcgtgccaacggcatagctgggtagctatgtgtggacgggataagtgctgaaagcatctaagcatgaagcccccctcaagatgagatttcccaacttcggttataagatccctcaaagatgatgangttaataggttcgaggtggaagcatggtgacatgtggagctgacgaatactaatcgntcgangacttaatcaaaataaatgttttgcgaccaaatcactttacttactatctagtttgaatgataaatacatcatatgctggngccataccaagggg

SEQ ID NO: 3973 - DNA, 400 bp; double-stranded, linear
tcttttaattacgtaatggcttaccagtttttaacatatgtgcaattctttcatatgattttttagattttagtaagtcaataaagccaattttctccaacgattgaatgtaacgttgattgataaatgtatttcttggtaaatcaccacccgctaaaattgtggcgatatttaaggcaatatgataatcatggtcgctaataaaatgaccccgtctttgcgcatctaattgtccttggatcaatgctttgaagtcttcacctaaagcgatatattgatgtctaggattcggaatatagtttgtttctgcttcatatttcgcacgtgtgagcgcaacttcgacacgntggtgcctggattngaaaataaaccgganccngggatccacgggaaataaccc

SEQ ID NO: 3974 - DNA, 400 bp; double-stranded, linear
tgccatgttcaccttgtttaaaatcaaggtttgtaatgtttccttgtgtcacgataataggcgtaatatcactctttgcatgattgcggatgtagtctaaatcaaagttgattaataaatcaccttgtttaacttcttgaccttcctcaacatgtaaagtaaagccttctccgtttaatttaacagtgtctaaaccgatgtggattaatagttctaaaccactatctgaatacaagaccaattgcatgttttgttgggaaaatcatttgttactttaccgttgaaatggtgcacgaaacttcaccttgtgangtttttggatagcgataccgtcaccccatccattttttttcgctgaaacacttggatcanggcacttctgaataaatggtggttaact

SEQ ID NO: 3975 - DNA, 372 bp; double-stranded, linear
cctttgcagcgcctccgttaccttttaggaggcgaccgccccagtcaaactgcccgcctgacactgtctcccaccacgataagngcgggngtttagaaagccaacacagctagggtagtatcccaccagcgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttaacgcctttcgtgcgggtcggaacttacccgacaaggantttcgctaacttaggacc

SEQ ID NO: 3976 - DNA, 395 bp; double-stranded, linear
agggaatcgaattttctttctcttcctncgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaaataacttaatctatgtttccaccatttttataagtcaaacgctcacatacggcttcgttttcattattttaaagctcatttacataagtaaactctgctttaaatgatttaactcattgtctgctaaaacggtttnttttatgaaaaggtttgaaacgggttn

SEQ ID NO: 3977 - DNA, 400 bp; double-stranded, linear
ttggtcccaaaccaagtgctctaccaagctgagctacttcccgtataattaacgcgcccgatagagtcgaacccataacctcttgatccgtagtcaaacgctctatccaattgagctacgggcgcatatgtttttattgaaaatggtgccgaggaccggaatcgaaccggtagtnnttcactcacgcagattttaagtcctgtgcgtctgccagttccgccaccccggcactataaaaatggagcagaagacgggattcgaacccgcgaccccaaccttggcaagttgttattctaccgctgaactacttctgcatatgcgggtgaagggagtcgaacccccacgccgtaggcttagatccttaagtctaagtgcgtctggccaatttccgccanacccg

SEQ ID NO: 3978 - DNA, 387 bp; double-stranded, linear
aagtggttaaatattatagaaaacatcaaaggatgttaagaaatacaatttattacccagcatttaataatggtgctatagaaggaattaataataagataaaattaatcaagtgaatttcttttggttacagaaatttcaacaactttaaagcacgtataatgatgattttcagcttgtacaaaggagaaaaaaagaagacaaccaagcccaataatggactggccgcctaataataaaagctctaaaagttgtattttaaaaatagttctttaaattatatacccaccacatttggtggaggaacctaaaaaaaagcacttcccaaaaatgggaaagtgcagtnagtggagccatagaggattccgaacctcggaccctcngant

SEQ ID NO: 3979 - DNA, 400 bp; double-stranded, linear
tggagcagaagacgggattcgaacccgcgaccccaaccttggcaaggttgtattctaccgctgaactacttctgcatatgcgggtgaagggagtcgaacccccacgccgtaanttagcatcctaagtctagtgcgtctgccaattccgccacacccgcaaatggtgagccatagaggattcgaacctctggaccctctgattaaaagtcagatgctctaccaactgagctaatggctcttccatggtgccggccagaggacttgaacccccaacctactgattacaagttcagttgctctaccaattgagctaggccggncaatatgtaagaataaatggtggagaatgacgggtttcgaaccgccgaaccctctgcttgtnaagggcagatggctcntc

SEQ ID NO: 3980 - DNA, 400 bp; double-stranded, linear
ttaccacgtatttaggtttctttggtggctctagatttgtccctattgtcacagcatttgccgcaatctttttaggtgtattgatgtttttcatttggccaagcatacaagccggcatttatcatgttggtggatttgtaacgaaaacaggtgccatcggtacttttgtttatggcttcatcttaagattgttaggtccactcggtttacaccatattttttacttaccgttttggcagacggcacttggtggtactttagaagtcaaagggcacttagttcaaggtacgcagaacatcttctttgctcaacttggtgatccagatgtgacgantattattccaggtgtgtcacgctttangtcagccgttttaatacgaggatgttcggctangtggtg

SEQ ID NO: 3981 - DNA, 400 bp; double-stranded, linear
cgacatacgctgataaattagttattaaacgtaatggtaacgttgtgacgacatttacacgtcgcaataatacgagtccatgggtgaaagaagcatctgcagcaactgtagcaggtattgctggaactaataatggtattactgttgcagcaggtactttcaaccctgctgatacaattcaagttgttgcaacgcaagggaagcggagagacagtgtagtggatggagcaacgtatagttggatttcacagttgtcgcaccacaaccgaaccaagcgactgactgaagatttggcaaaatggncatattgatatcacgcctaatgantccattcaggacatttaattaatccaactcaagcaatggatattgcttgacactgaaaaatgggtaantggtg

SEQ ID NO: 3982 - DNA, 400 bp; double-stranded, linear
tttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacgaaaattataggtgttgaaccttcagtgcaagtagtatgtatgaatctgttgtggtaaataatcaggtagtcacattgcctaatatcgataaatttgtgggacggtgcatctgtagctagagttggcgatattacattggaaattgccaaagaaaagtagaggattacgttccagtagagn

SEQ ID NO: 3983 - DNA, 390 bp; double-stranded, linear
ccaccattatttgtacattgaaaactagataagtaagtaaaatatagattttaccaagcaaaaccgagtgaataaagagttttaaataagcttgaattcataagaaataatcgctagtgttcgaaagacgcgacaagattaataacgcgtttaaatctttttataaaagaaaacgtttagcagacaatgagttaaattattttaaagcagagtttacttatgtaaatgagcatttaaaataatgaaaacgaggccgtatgtggagcgtttgacttatnaaaaatggtgggaaacatagattcaagttattgaagggcgcacggtgggatgccttgggcactagnaagccgntggaaggacgttactaacgacgatatgccttgggggagc

SEQ ID NO: 3984 - DNA, 400 bp; double-stranded, linear
gggctctaacatattcttaaattgatcaaatagttcttgccttgtatctgcaaatgttttgtagtctgcatgcaatgtgagtgcttgatgaattttgaccacaaattcaaatgtatcaggcgtttcttttatccatttcaatatatttctttccggttgtatcgcatagtatgtcgcatctaattcgacaaccggaaaatgtccagcatatgttttaagtttatcggtttggcgttctaaatcttcatataatgaatagtgatcaccccaacctgttaatccgatgttttatcatatatatcaccaatgtcatcataccatataacttttatcatnatcatttcagcgaactttaggtttgnaggttttttggcctggattaaanatctttcgggcggat

SEQ ID NO: 3985 - DNA, 400 bp; double-stranded, linear
gcatttgcttatatctttaaaaaagattttgaagatattgaaagaaaaactaaagaaattatttctgatattgaaagtaaaaataactaataacatttagaggctgggacataaatccctaaaaancagcagtaagataattttcaattagaaaatatcttactgctgttctctatttatacaatacttcgtattgaaatggcttcgctttcctagggtgccgtctcagccttggtcttcgactggcactgctccctcaggagtctcgccattgaatactacgtattaacatgtnaattttactttggaaatacttttaaaaaataagacactttgcccaacttggcacataaatgttaaaatncaatgaaatgaattttctgtgttgggtcccctncta

SEQ ID NO: 3986 - DNA, 400 bp; double-stranded, linear
ttcgttcaaagtcatctaggtcacattattctatttgggattcttagtgctgttcttatttgcggctttaacgtcatctatttctttattagcaattaaatgtttctaacttcacgaagaatgacaatacaaaacgtaaaaaagtcgcagtgatcggtagtattttagtatttatcattagtattccagcaaccttatcttttggtatcttaaaagatgtaagattcggtgcgggaacgatttttgataatatggatttcatcgtttcgaatgtattgatgccattaggcgcattaggtactacgcttgtcgtaggncaattattagntaaaaaattattacancaatattttggtaaagancgatttaggattattcagtggttggtattacttaatta

SEQ ID NO: 3987 - DNA, 400 bp; double-stranded, linear
ggattcgaacccccgcgagccgttaagcccctgtcggttttcaagaccgatcccttcagccggacttgggtattcctccaaaattatatggaccttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggggactancgggatcggaaccgctggacctcctgcgtggcaaagcaggccgctctcccagctggagctaagncccccataataatnacagtatatcngggaagacaggat

SEQ ID NO: 3988 - DNA, 400 bp; double-stranded, linear
cagctgataaacaagttgatctggtcccgatttgttgggtaaacggttgattaatgnaaaatgttcgccgaaggattcataatccgagaggtctaattcaacgtatcattaatcaagatgcgcctatttatcaatctgaaacaaattatcattcgaaagatcgcggtaagtctaaaaatggtattcaaatggtgtatcaacatttaatgaacggtgtatcgtttatggntccttttatcgtagttggtggactccttatcgccatcgcgctgactcctaggcggtgaacgaccatccaaaaggattagtcatcccagatgattcattttggaaatccattgaaaaccatgggtagtttagcctttaaattaatggtcccataccagncgggataaacgct

SEQ ID NO: 3989 - DNA, 363 bp; double-stranded, linear
ccagagatttccgaatgggggaaacccagccatgagttatgtcatgttatcgatatgtgaatacatagcatatcagaaggcacacccggagaactgaaacatcttagtacccggagaagagaaagaaaattcgattcccttagtagcggcgagcaaacgggaagagcccaaaccaacaagcttgcttngnggtntgtaggacactctatacggattacaaaggacgacattagacgaatcatctggaaagatgaatcaaagaaggtaataatcctgtagtcgaaaatgttgtctctcttgagtggatcctgagtacgacggagcacgtggaaattccgtcggaatctgggaggaccatctcct

SEQ ID NO: 3990 - DNA, 400 bp; double-stranded, linear
tttccaagaacatgagcctgtacagttaacaccatgtntgnttcttacttctttatcgtggctccaacgttctctgtacattttttcccattctctacttttactttctaggatcgaccaattcccattaaatttttctgttggcttaaagaaattcaatccaaattttcccatatttatatcctcctacgtataaaaatacgatgtgtagatgtcgtgtttttaaatactttaaaatgcccaagactattgctttaattagattgtacattttttcacaaacataaaatattagggaatcacctaattacttaaggnattccctatcaataacgggatttcattgaaataatacacaatcagtanggtcagcctaatgccaggctaaatcgttcaaatt

SEQ ID NO: 3991 - DNA, 400 bp; double-stranded, linear
aaagtggttaaatattatagaaaacatcaaaggatgttaagaaatacaatttattacccagcatttaataatggtgctatagaaggaattaataataagataaaattaatcaagtgaatttcttttggttacagaaatttcaacaactttaaagcangtataatgatgattttcagcttgtacaaaggagaaaaaaagaagacaaccaagcccaataatggactggccgcctaataatnngagctctaaaagttgtattttaaaaatagttctttaaattatatacccaccacatttggtggagaacctaaaaaaaagcacttcccaaaaatggaaagtgcaagtagtgagccatagaggattcgaacctctgaccctctgattaaaagtcagatgctct

SEQ ID NO: 3992 - DNA, 400 bp; double-stranded, linear
agtgtatggttatcaaagatttgatacgacggtcattattattaccgttattgtattagtcattattgtccaagtgattcaaacgctagggaatgttctagctagattcatacgtngacattaatgatatatagtgaagattttgaaaggaattgatagaatgaaaagattgattgggttagttatcgtagcacttgtattaattagcagcgtgtggtggtaacaatgataaaaaagtaacaattggtgtcgcatcaaatgacactaaggcttggggagaaggttaaaagaattagctaaaaaaagatggatnttgatgtgggagattaagcacttcctcnggattacaatttaccggattaaagccttnaaatggatggtgatattgataatgaatgcc

SEQ ID NO: 3993 - DNA, 383 bp; double-stranded, linear
aagaattttcgacatttatctcgtaaagaaaagttacaacaattggttgataagcaatggttatcagaagaacaattcgacattttactgaatcatccattaatcgatgaagaagtagccaatagtttaattgaaaatgtcatcgcgcaaggngcattacccgttggattattaccgaatatcattgtggacgataaggcatatgttgtacctatgatggtggaagagccttcagttgtcgctgcagctagttatggtgcaaagctagtgaatcagactggcggatttaaaacggtatcttctgaacgtattatgataggtcaaatcgtctttgatggcgttgacgatactgaaaantntccgccggcattgagagccttaga

SEQ ID NO: 3994 - DNA, 366 bp; double-stranded, linear
ggtactatgatttcaccgagtctctcgttgagacagtgcccaaatcgttacgcctttcgtgcgggtcggaacttacccgacaaggaatttcgctaccttaggaccgttatagttacggccgcctttactggggcttcgattcgtagcttcgcagnnaaaccnactcctcttaaccttccagcaccgggcaggcgtcaccctgatacatcaccttacggtttagcagagacctgtgtttttgataaacagtcgcttgggcctattcactgcggctcttctgggcgttaaccctgaaagagcaccccttctcccgaattacggggtcatttgccgattccttaacgagattcgctcgctcaccttaga

SEQ ID NO: 3995 - DNA, 359 bp; double-stranded, linear
agatattttacatgtgaatcaagtaggtattcatgataatttctttgaattaggtggccattcattaaaagcaacgttatgntgaatcggatagaggcatctactgggaaacgattacaaattggtgatttattacaaaagccaactgtatttgaactagcacaagcgattgctaaggttcaagaacaaaactatgaagtgattccagaaactatagttaaagatgattatgtgctgagctctgcacaaaagcgtatgtatttattatggaaatcaaaccataaagatacggtgtataacgtaccttttttatggcggttatncatcagaacttaatgtagctcantgcgacaagcatg

SEQ ID NO: 3996 - DNA, 400 bp; double-stranded, linear
caattattggtattcaacttaaagatcatgatgatttaatacaactcaaacaacgttnaaatcatttcgatccttccaatatttatattaatgaaaataagatgttatattcattgttaatttaacacatagtaagaaaaacagtcataaattgatttctaattgaaatcatcttatgactgctttttattatactttacatttctcgtttcgtcagattcaaacgttttcacttcgccaagccatctttctttgtgtttgcttttattttgacgttttagacataaaaaaagagaccttgcggtctcaaatgcggctcatcgcatccactttttgcctgggcaacgttctactctaggcggaangtaagtgggacttaccatcgacggntaaggggctt

SEQ ID NO: 3997 - DNA, 358 bp; double-stranded, linear
gatactaccctagctgtgttggctttctaacccgcaccacttatcgtggtgggagacagtgtcangcgggcagtttgactggggcggtcgctcctaaaaggtaacggaggcgctcaaaggttccctcagatggttggaaatcattcatagagtgtaaaggcataagggagcttgactgcgagacctacaagtcgagcagggtcgaaancggacttagtgatccggtggttccgcattgaagggccatcgctcaacggataaaagctaccccggggataacaggcttatctcccccaagagttcacacgacggggaggtttggcacctcgatgtcgnctcatcgcatcctggggctgta

SEQ ID NO: 3998 - DNA, 400 bp; double-stranded, linear
taggaggaatttatatgacatttgaaaaagaaacggtcttaaaaacattatttcctgaagatgtacttagtattgctaaaggtttaacagacggtgaagtcgaatttttacaacaagtagattcattgctagaaagtaagtaccgtgaaaatattaatcaacattggatagacgctactgtacccgaggactattttaaagatctgggagarttaaattattttaacartccattactttacaaggatcgtccaaacgccaaaatgcctagtcanctatttcagtttttcatgtcttacctactcgcgcgatttgatatttccttagctaccctactcggtgttcaccaaggttagggcataacactttctatttcggaggtagcaaagacaaattgcga

SEQ ID NO: 3999 - DNA, 398 bp; double-stranded, linear
cgccccttagtgctgcactaacgcattaagcactccgsctggggagtacgaccgcaagtgaaactcaaaggaattgacggggacccgcacaagngtggagcatgtggtttaattcgaggcaacggtagaaccttaccaaatcttgacatcctttgacaactctagagatagagctttccccttcggggaccaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaacccaggaaggttggggatgacgtcaaatcatcatgccccttatggntttgggttacacaagtggttacaatggg

SEQ ID NO: 4000 - DNA, 377 bp; double-stranded, linear
tgttcttgcaacgctatttagtatcaggtttaacaacaggtgcgacaaaaggttagtttgaaattaggagtggggcagaattgataaagaaccactaatgacgataaagattaaaaggaggacgttatgatgacgattaaagttggaatcattgggtgtggtggtattgcgaatggcaagcacatgccaagtttacaaaaagttgaaaatgttgaaatgatcgcattttgtgacgtagacatttcgaaagcagcgagtgcggcagaagcatacggaactgacaatgscaaagtttatgatgattacmaagcattgttaaaagatgacacgattgatgttatccatgttttgtacccccaatggaccccgcattgtgg

SEQ ID NO: 4001 - DNA, 387 bp; double-stranded, linear
tcgggttctcaaatcatcgaacataacaaaagaagctaagcaacatgtaggccgttgtcacttaacttcttgtttttccgatgacagcttctatttagagaatgtcatgattattttatattcacttcaatgttatcaatattagtgccatctatgacatctgccatgcgattttcttgtaattttttgtgcaattcaaacgtgtactttccaccgtttttcattttaataacaattttacctgaaccaacgttaccgtacagattatttttttcaataagtgttttctcaatttaaaatcaagttctttcaaggaaatctgttctttagtaatcttgaattctgaaacatcatgggngattgtaccgtatnatcttncctagtaat

SEQ ID NO: 4002 - DNA, 400 bp; double-stranded, linear
ctattacgattgctgcgaaagaaggtattaaaaatatacaaataggcatggctcaccgtggacgtttaaacgttttaacgcatgtcttagaaaaaccgtacgaaatgatgatttcagaatttatgcatacagatccaatgaaattcttacctgaagatggtagcttgcagttaactgctggatggactggtgatgtgaaatatcacttggtgggcattaaaactactgattcatacggtacaatgcagcgtattgcactggctaacaatccaagtcacttggaaattgttgcacctgttgttgaggggcgtacgagagcagcacaagatgatacacaacgagctggggctccgacgactgtccatcataaangcaatgnccattgttgatacatggcgat

SEQ ID NO: 4003 - DNA, 400 bp; double-stranded, linear
agaaatatatgcatttcggatatcatggtaaagagaatggattaagcggtaaatcacgtgatgaagtgcgagcgaaatgaaacaaaatttagatgtcatgcgagacgataatcaaagggacgacaggtgatggggttgaaagtgtaacgngctacactggtcatgatgctgctaaactacgtgattataatgaaacacatcatgctttgtctggatatgaaatgattgacgcagcaaaggtgccattgcaacaaatgaagtcaatgctgcgatgggtattatttgtgcacgccaacagctggttcctcgggtaccattcccggtgcactttttaaattaggaaaaaacacatgatttaacagaagagcaaatgatttgatttcttattcacttcagcatt

SEQ ID NO: 4004 - DNA, 400 bp; double-stranded, linear
tgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcgaaagcgagtctgaatagggcgtttagtatttggtcgtagaccgaaaccaggtgatctacccttggtcaggttgaagttcaggtaacactgaatggaggaccgaaccgacttacgttgaaaaagtgagcggatgaactgagggtagcggagaaattccaatcgacctggaggatantggttctctccgaatagtttagggctagcctcaagtgtgattattgaggtaganactgtttgacgaggggccctctcgggtaccgaattcagg

SEQ ID NO: 4005 - DNA, 415 bp; double-stranded, linear
atactaaggcgttattagacgattagacaatggtgtgattaaaggtgcagcacttgatacgtatgaatttgaacgcaaacttttcccaagtgatcaaaggggcaaaacactgaacgatccattgttagaatcgttgattgacagggaagatgtcatattaacaccacatattgcgttttatactgaagctgcagttaaaaatctaattgtcgatgcattagatgcaacattagatgtattggcagactggagatactaggttacgagtaaattaaaaatcgaactgatgagataatttggattgttggggattctgcatccagttcgatttttttaatttggtgttggatgacgttgnaatgttgcctaatttaaacgacatcgtaaaccntggatcctccaatggcgtccttnc

SEQ ID NO: 4006 - DNA, 444 bp; double-stranded, linear
ctaacagaagctagtataggaaatcggtactcgttaaggctgatctgtgatggggagaagacattgtgtcttcgagtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggagaaggggtgctctttagggttaacgcccagaagagccgcagtgaataggcccaagcgactgtttatcaaaaacacaggtctctgctaaacccgtaagtgatgtataggggctgacgctgcccggtgctggaaagttaangagagtgggttacttcttgcgacttancgaaatcgagnccccagtaaacggcgggccgtaactataacngtcctaaggta

SEQ ID NO: 4007 - DNA, 400 bp; double-stranded, linear
tttgaactctatcaaagcatcagcaatcaaaacatacgtatctttacaacagtaatcatgcattctatgatgcttctaactgaattaaagcatcgaacaatcggaagcatatttctaaattatttattcattatagtcttaaacataacatgacctaatatattactaacctattaaaataaaccacgcacatctaagtgatatacgacaatcacagcaataataattgctttagaaagtcgtgccgaactggaacttacaagtctagttcgaacacacactgatgtgagtggttttctttattttaaacatgaacaatcagataagttactagcattagcaaatattattaaatcaagggcttcgnttcataaatttaaaacatgttaaattagacgtg

SEQ ID NO: 4008 - DNA, 400 bp; double-stranded, linear
tatacttgtttttacaaaccacaaaaagctctaaacattagtttaaaccaatgcttagagctttctaattattttatgctttaaaagatactgtgttatctacgatgaccttaccgtctttaataactttttctgcgtgattgataccaaaatgatatggaatatattcatgatttggtgcatcccaaattactaaattagccttatcacctgtgttaattgtacccgcgttaatgtctattgctttagagccattgaccgtaacagcattccaaacttcattaggtgatagctttaatttcaaggctgcaatcgccataacaagttgtaagttgtttgtggacactactaccagggttataatcagttggctaatgccatcggcaccggttaatggtcc

SEQ ID NO: 4009 - DNA, 400 bp; double-stranded, linear
acaaacattgaaattagaggtatataaaaaatgcttctgcaatagatgcaataaacatgcaatacaatatggaggcgaagtaaatgaaaagtattacgtttgaagaacattatgtcattgaagatattcaaaaagaaacgatgaatgcgatatcagcagatcctaaaggtgtaccgatgaaagtaatgttagaaggccttgaaaaaaagacaggttttacaaatgccgacgaattatcacatcatgatgaacgtatccaatttatgaataatcaagacgttcaaattcaagtcttatcttatggaaatggttctgcttcaaatttggttggtcagaaagccattgaattatgtccaaaaggcaaatgatccattgggcaaactatattgcaccatatccc

SEQ ID NO: 4010 - DNA, 400 bp; double-stranded, linear
actagagaaggtatgttacgtgacaatgaattactaaatggtatttattcatcgagttacatctatagtttattaaaatcagaatacgaccaaaaatgacaaattagacttacaaaagagtgatgacatttaaaatggcagcgctcttttatttaatttttgaaaataaaaggttgttgacagtattattttataacaatataatgattttgataattattatcaactagatgatgtttatgggaggatgctttaaaacagccgttttaagtgtaatgtattattttagcgtgtagggatgcgaaaatatatttataggacacatcttggggataatngatttctataatgaggtgtcaaatggaaaagttaccacgctattattagccnccacgttatt

SEQ ID NO: 4011 - DNA, 494 bp; double-stranded, linear
tntcaattagaaaatatcttaccgctgnctctatttatacaatcctcgtattgaatggntcgctttcctagggtgccgtctcagcatcggcttcgactggcactgctccctcaggagtctcgccattaatactacgtattaacatgtaattttactttgaaatactttaaaaaaataagacactttgcccaacttacactaccaataaaaacttctgttagaattcctcaaaatgatatttcgcgacatgttaatgaaattgttgaaacgatacctgatagcaaattcgatgaattcagacatcatcgtggcgcaacatcctatcatccaaagatgatgttaaaaatcatcttatatgcatatactcaatctgtattttctggtcgtagaatagagaaattacttcatgacagtattcgaatgatgtggttagctcaggtccaaacancttctnataaaactattaatcgttttggggtggaatccnaatactg

SEQ ID NO: 4012 - DNA, 400 bp; double-stranded, linear
tttcacttcgccaagccatttttctttgtgtttactttttattttgacgttttagacataaaaaaagagacctcacggtccaacttgcctggcaacgttctactctagcggaagtaattggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtcccaatgcgggctcatcgcatccattttttggcctgggcaacgttctnatnccagcggaantnaat

SEQ ID NO: 4013 - DNA, 400 bp; double-stranded, linear
cgaactgccgaacccgaagagcggatttacagtccgccgcgtttaccacttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcggtgtcttaaccgcttgaccaaggagccatggctccacaggtaggactcgaacctacgaccgatcggttaacagccgatagctctaccactgagctactgtggattaatattatgcctggcaacgttcttactctnagcggaacgtgaattcgacttaccatcgacgntaaggagcttnac

SEQ ID NO: 4014 - DNA, 400 bp; double-stranded, linear
attaggacctcaagacgatattactaaatttgaatacttaaaaaaatcttctcaaaatacaggtacttcattattggtattcaacttaaagatcatgatgatttaatacaactcaaacaacgtgtgaaatcatttcgatccttccaatatttatattaatgaaaataagatgttatattcattgttaatttaacacatagtaaganaaacagtcataaattgatttctaattgaaatcatcttatgactgcttttacattatactttacatttctcgtttcgtcagattcaaacgttttcacttcgccaagccatctttctttgtgtttgcttttattttgacgttttagacataaaaaangngacctgcggtctcaatgcggcttcatcgcatccactt

SEQ ID NO: 4015 - DNA, 377 bp; double-stranded, linear
gaatgaaaagctctaaaagttgtattttaaaaatagttctttaaattatatacccaccacatttggggaggaacctaaaaaaaagcacttcccaaaaatggaaagtgcaagtagtgagccatagaggattcgaacctctgaccctctggattaaaagtcagatgctctaccaactgagctaatggctctgaatggctgggctagctggattcgaaccaacgagtgacggagnaaaggtccgttgccttaccgcttggctatagcccaatatatagatggtggaggggggcagattcgaactgccgaacccgaggaggcggatttacagtccgccgcgtttagcccacttcgntacccctgccagnttattcatatga

SEQ ID NO: 4016 - DNA, 400 bp; double-stranded, linear
cccagagttttncacgaatatatggatatttgattcgaggactgtattcataccaagagaatgacgcacctgacatcctctcggttcatattcaggcatatccggaccacaacttggatagtcagtttgttgattttcccaggtaatcacaccatttttcacaaatactttccaagaacatgagcctgtacagttaacaccatgtgttgtttcttacttctttatcgtggctccaacgttctctgtacattttttcccattctctacttttactttctaggatcgaccaattcccattgaaatttttctgttggcttaaagaaatcaatccaaatttcccatatttatatcctcctacgggtgaaaaatacggtgtgtagangtcgtggtttttnaaata

SEQ ID NO: 4017 - DNA, 400 bp; double-stranded, linear
ctttgagcgcctccgttaccttttaggaggcgaccgtcccagtcaaactgcccgnctgacactgnctcccaccacgataagggcgtgggttagaaagccaacacagctagggtagtatcccaccagcgnctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgtctttcgttgcgggtcggaacttacccgacaaggaatttcgttaccttaggaccttatagttacggccgnctttaattggggttt

SEQ ID NO: 4018 - DNA, 400 bp; double-stranded, linear
tgtcgatttaagaggcatgctacgaggaatgattggtcatccgaaaaaagatcgagcggcatatgaggcacgccaagcgattccaaacattaatgaaaacagtccgccaatattaattgtacatggagggaaagaccagcaagttggtattcatcatgcgtattatttagcggaccaactagagttaaaaggtgccacgcatgnaaacattttatcaaatggcagaaggacatgtgccaagaccaccagcgatggttgaaacattgacttatattaaagagtttatgaaccaagttgagtcgcatagcttagttatggaaacgtggtgtgcgcatggggaactattcaagctttggaggatgtggtacttacatgcgttggaattaggggtccggttact

SEQ ID NO: 4019 - DNA, 400 bp; double-stranded, linear
ggaggtttggcacctcgatgtcggctcatcgcatcctggggctgtagtcggtcccaagggttgggctgttcgcccattaaagcggtaccaagctgggttcagaacgtcgtgagacagttcggtccctatccgtcgtgggcgtaggaaatttgagaggagctgtccttagtacgagaggaccgggatggacatacctctggtgtaccagttgtcgtgccaacggcattagctgggtagctatgtgtggacgggataagtgcttgaaacatcttaagcatgaagcccccctccaagatggagatttcccaacttcggtttntaagatccctccaaagntgatggaggtttaataggtttcgaggtgggaagcanggtggacagttgggagctggacgantac

SEQ ID NO: 4020 - DNA, 400 bp; double-stranded, linear
gaagatgttcgtcattcttcaaataaaccagagctagttgcaattgctgaaccagcatctaatagaccgaaaaagagaagtagacgtgcggcaccggcagatcctaatgcaactccagcagatccagcggctgcagcggtaggaaacggtggtgcaccagttgcaattacagcgccatatacgccaacaactgatcctaatgccaataatgcaggacaaaatgcacctaaccgantnttgtcattttgatgacaatggtattagaccaagtaccaaccgttctgtgccaacagttaaacgtttgttaataacttgccgggcttcacactaatcaatggtgggcaaagtangggtgtttagtcatgcaatgggtaagaacgagcatgtttggatttcaggg

SEQ ID NO: 4021 - DNA, 396 bp; double-stranded, linear
ctaagtcatgaatgggaagtggctcgcgttgaagaaggactgactactgctgccacacagcttgctaaacaattatcagaattagatttagcgtcacatccttttgtgatgtcagagcagtttgcaagtntaaaagatcgtccatttcatccattagctaaagaaaaaagaggattaagagaagcggattatcaagtgtatcaagctgaattaaatcaatcatttcctttaatggttgcagcagttaaaaagacacatatgattcatggcgatactgcaaatatcgatgaattagaaaatttgacagtacctataaaagaacaagcgacagacatgttaaaatgatccaaggttatcantagatgactatgtaccattccggtacntcctggccat

SEQ ID NO: 4022 - DNA, 376 bp; double-stranded, linear
gattggtctgnaagaagaattaatggaaaagctacgtgaaaaattagaagcggcatttgatacgatttacgaattgtctcaaaaccgaaaaatagatatgagacttgcagcatatatcataggtattaaacgtacagcagaagcagctagatatcgtggttgggcataattaattatcatatgtgatttaacgagcttgggacagaaaacaaagccctaagctcgttaattttattttagcagtagttgactgtaaaacaatgcccgtgtaaacgctcttttcaaaaatagtcggggccccaacacagaggctggtgggaaagtcagcctacaatagngtgcaagttggcnggggccccaacacagaggctggcgg

SEQ ID NO: 4023 - DNA, 381 bp; double-stranded, linear
caaatggtggagccataggaggattcgaacctctgaccctctgattaaaagtcagatgctctaccaactgagctaatggctcttccatggngcnggccagaggacttgaacccccaacctactgattacaagtcagttgctctaccaattgagctaggccggcaatatgtaagaataaatggtggagagtgacgggttcgaaccgccgaccctctgcttgtaaggcagatgctctcccagctgagctaattctccgatttaaaactgcctggcaacgttctactctagcggaantaattcggactaccatcgacgctaaaggagcttaacttctgtgttccggcatgggaacaggtgtgactccttgctatatcaccagac

SEQ ID NO: 4024 - DNA, 400 bp; double-stranded, linear
gccccttatgatttgggctacacacgtgctacaatggacaatacaaagggcagcgaaaccgcgagtcgaagcaaatcccataaagttgttctcagttcggattgtagtctgcaactcgactacatgaagctggaatcgctagtaatcgtagatcagcatgctacggtggaatacgttcccgggtcttgtacacaccgcccgtcacaccacgagagtttgtaacacccgaagccggtgggagtaaccttttaaggagctagccgtcgaaggtggggacaaatggattggggtgaagtcgtgaacaaggtagccgtgatcggaaggtgcggctgggatcacctcctttgctgaaggatgatgatttcggnaacatcnttcttccagaagatgccggtaataa

SEQ ID NO: 4025 - DNA, 352 bp; double-stranded, linear
cttagaagtgagaatgccggtgtgagtagcgaaagacgggtgagaatcccgtccaccgattgctaaggtttccagaggaaggctcgtccgctctgggttagtcgggtcctaagctgaggccgacangtanggcgatggataacaggttgatattcctgtaccacctataatcgttttaatcgatggggggacgcataggnataggcgaggtgcgattggattgcacgtctaagcagtaaggctgagtattaggcaaatccggtactcgttaaggctgagctgtgatggggagaagacattgtgtcttcgagtcgttgatttcacactgccgagaaaagcctctagatagaaa

SEQ ID NO: 4026 - DNA, 370 bp; double-stranded, linear
tggggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatcaccgtgcgcccttaataacttaatctatgtttccaccatttttataagtcaaangttaacatgaagttaggttcttttataaaaggattaaangggttattaatcttgtgngtgttctttcg

SEQ ID NO: 4027 - DNA, 400 bp; double-stranded, linear
tcatgtttcgcttggtttaatgctgttaatgcgttatcgacacgatgtttttcatctgaaatttgttgtgcagttgcatcgccattgtcaataacacgttgagctgcagttatttcagtttctgcttccgcttcttcgcattatagttatcaatactttgttgcgtcataccagcagttgatggtacttggttcacagaactttgtaagttatttttagacgttactaattggctattatcttctttattttgaagtaatgctttacttggatcaatcttagtttgtgcgcacgaactttagttagtgcgtgcagaaacttgttgtggtgttgcacgctcattnatgaagcactgttggtgcctccgttttcgcatantggattgttgttgcgcatgagg

SEQ ID NO: 4028 - DNA, 400 bp; double-stranded, linear
ctcatcgcatccattttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctgggcaacgttctactctagcgggaacgnaagttgggcttaccatcgacgctaagaacctttcttggacttggtggacaaacggngtggctgcttttcc

SEQ ID NO: 4029 - DNA, 400 bp; double-stranded, linear
aggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgatttaaaactgcctggcaacgttctactctagcggaantaattcggactaccatcgacgctaaggagcttaacttctgtgttcggcatgggaacaggtgtgacctccttgctatagtcaccagacatatgaatgtaatttgatacattcaaaactagatagtnaagtgaaaagtgattttggnttcgcaaaaccatttgattttgattgaagtccttcgatcgattgagtgattcgtgcagctn

SEQ ID NO: 4030 - DNA, 390 bp; double-stranded, linear
gatgataaatcatgtttttcataccaagtcgctgccggcaaaacaatgtcagaatataacggtgttgccgtcattctgaagtctaaagagaccactaaatctaacttacctgttgtttcttcacgccacgtaatttcttctggcttttcatcttcatttggtgtagctaataaccctgattttgtgccaagtaaatgcttcataaagtattcttgaccttttgcagaacttgaaattaagtttgaacgccatataaataatgattttggatgattcttttcaaatcaggatcttctattgcaaattgtggtttgtnttggatttcacntcatcaattgcacgttgcaaaatcgcttcatgtgaatctataccctgcatcttgtagcntcc

SEQ ID NO: 4031 - DNA, 400 bp; double-stranded, linear
tggttcgaatccagctagcccagttattggcggcatagcaagtggtaaggcagaggtctgcaaaacctttatcaccggttcaaatccggttgccgcctccaggtttatgcgggagtagttcaacttttagaacacgttccttcccggaangaggtataggtgcaaatcctatcttccgctccataatttaataataatgcgggagtatttcaactcttagaatacattccttcctggaatgaggtataggtgtaaatcctatcttccgctccataatttaatatttgcggggagtagttccaacttttagaacacgttccttcccgggaaggaggtatangtgtatcctatcttccgcnccataatgccttccaaaggggaattttttggtttnaccatt

SEQ ID NO: 4032 - DNA, 400 bp; double-stranded, linear
gtatcgatgagtttcttcggtgcgtcttcgacagccattttgacttcgacaaaatgcatcacatcgggatgaccattaattgcattaaacgtgtcttgtaaatcttttgatgattcaacgtcatgaatttcaacatttttaccaccaaatacagctggtaaagctttataatcccacatgtgaatttcattataaggttcatacatgccgtgaataagtcgttctaccgtrtrgccgtcattattaatcaccaataataccgggttaatatgctgtctaatcatagttggaaatagcttgaacagttagttggccatgagccatcacccatttaataataagttacgacggatctttggtctgccaattgggggancncaatgttgcagggnaatggtat

SEQ ID NO: 4033 - DNA, 400 bp; double-stranded, linear
cacgacgttctgaacccagctcgcgtaccgctttaatgggcgaacagcccaacccttgggaccgactacagcccccaggatgcgatgagccgacatcgaggtgccaaactccccgtcgatgtgaactcttgggggagataagcctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgattccaaccattctgagggaactttgaagcgctccgtaccttttaaganggcgaccggcccagtcaaactggccgctgacactgtcttccaacacgataagtggtgcgggttaga

SEQ ID NO: 4034 - DNA, 400 bp; double-stranded, linear
aattccatgtgtacggttgaaatgcgcagagatatggaggaacaccagtgncgaagcgactttctggtctgtaactgacgctgatgtgcgaaacgtggggatcaaacaggattagataccctggtagtccacgccgtaaacgatgagtgctaagtgttagggggtttccgccccttagtgctgcagctaacgcattaagcactccgcctggggagtacgaccgcaagttggaaactcaaaggaattgacggggacccgcacaagcgtggnagcatgtggtttanttcgaacaacgcagagaaccttaccaaatcttgacatcctttgacaactctagagataaagcctccccttcggggacaaatgacagtggtgcangttgtcctcactcgtgtcgtga

SEQ ID NO: 4035 - DNA, 400 bp; double-stranded, linear
ttcgctttgcccgtctgtcacattactgtaaaattctataaatagaatttttgatgacgggtcccttcctagggtgccgtctcagccaccccaaccggcacattgttgtaagctgactatatgtcacttctgtgttggggcccctgtcttcgactggcactgctccctcaggagtctcgccattaatactacgtattaacatgtaattttactttgaaatacattaaagcccaaattaatcaaaagctttctgaaccagaaacgaaaaaaatctatagtcatagaaaaatttatgtagagcctgtttttggatttatgaaggctatttggggttcactcgaatgtcagttcgaggaataatnaagtnaacgagagccaggtttgtaattatggcactnat

SEQ ID NO: 4036 - DNA, 400 bp; double-stranded, linear
taaatgttgaaaaagcacgattagatagaattttgaataacaatgaaattcgtcaaatgatcacagcatttggtacaggaatcggtggcgactttgatctagcgaaagcaagatatcacaaaatcgtcattatgactgatgccgatgtggatggagcgcatattagaacattgttattaacattcttctatcgatttatgagaccgttaattgaagcaggctatgtgtatattgcacagccaccgttgtataaactgacacaaggtaaacaaaagtattatgtatacaatgataggggacttgataaacttaaatctgaattgaatccaacaccaaaatggctattgcacgtacaaaggcttggagaatgaatgcagtccatttgggaacacatgacctg

SEQ ID NO: 4037 - DNA, 381 bp; double-stranded, linear
tcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaantaaattgggctaccatcgacgctaagaacctttcttgacttgtgacaatcgcttgcttctttcctcttcttcggctctcgcttacncatttagctctacnaaactcgttgcgctctt

SEQ ID NO: 4038 - DNA, 360 bp; double-stranded, linear
ctgtttgtcatacttcataaatcctttaaattcacccatcgtatctccccctttccttaatacacaacggctggtttatgtttagcatcgattgttttactgtcatcgtaaaatgcagctaacatcgcttcatcttcattgtcatgtaatgatttgtgcaaatgaattttttgcatcattaattgataatctttaggaataactttaacgacgacatcttcaatgcgatcaaaatgttttaacacatgaatcgctctcgtactattcgtgtgtgacacatgtncttccagcatttgcttaatgaatgcttttncttcttggtgtttaatctttgtaaacgaaagcgtatctagtgatang

SEQ ID NO: 4039 - DNA, 400 bp; double-stranded, linear
agtgcgaacccataacctcttgatccgtagtcaaacgctctatccaattgagctacgggcgcatatgtttttattgaaaatggtgccgaggaccggaatcgaaccggtagtgantgcactcaccgcagattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaagctnaggatcctaagtctagtgcgtctgccaattccgccacacccgcaaatggtgagccatagaggattcgaacctctggaccctctggattaaaaagtcagatgctcta

SEQ ID NO: 4040 - DNA, 378 bp; double-stranded, linear
ctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcntactcatttagctcnactaaactcgttgcgctcttgttctcgtttcgggcagattcaaacgnttgtca

SEQ ID NO: 4041 - DNA, 400 bp; double-stranded, linear
gtaccttaacaatatctcgaaatggacgaactaaattatgaaccgcatgaaaggatacttgcgaatcatttgagcatgcttgaatcataatatcaccatcgctgtaatcgtctattaactgatcattcggaaaatgcggtaaatctttaaaggcatcgggaattttactagataacccaattttcttcatcaaagacttactaatcccaaaggtaatcgttaacttgcttgcacctaatcctatcgattcaccggtatctactggtgggcattaaaggattgttactcgggcttggccaactgtatcaccatccatcatacgattcagccataacggtccacttttttaaacattggctttattggcacccnaacctttggacttcnaatctaacggcca

SEQ ID NO: 4042 - DNA, 400 bp; double-stranded, linear
gacttgcaaacgttgtgatgacggtcaagaaaactggtaacacaccagacggacgtaaagctggcgaaccatttgctccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaaggaatatccacagttaacaatccgtgtatctggttacgctgttaacttcattaaattaa

SEQ ID NO: 4043 - DNA, 400 bp; double-stranded, linear
ctattttatctaaagttaaacctgacccacctagaattgacgcaaactctgtgacatataaagcaggtcttacaaaccaaganattaaagttaataacgtattaaataactcgtcagtaaaattatttaaagcagataatacaccattaaatgtcacaaatattactcatggtagcggttttagttcggttgtgacagtaagtgacgcgttaccaaatggcggaattaaagcaaaatcttcaatttcaatgaacaatgtgacgtatacgacgcaagacgaacatggtcaagttgttacagtaacaagaaatgaatctgttgattcaaatgacagtgcacagtgaacagtggacaccacaattgacaagccaactactgaaggcgcngtgnttattaaaag

SEQ ID NO: 4044 - DNA, 375 bp; double-stranded, linear
aaaatggcttgatttgaaaaacgaccagcatgcgctactggnataatagcgaggctaccatgttgtttcatcgtagncgcatgttagttaatccagggatacaagcatcatgatcaatattaaagccatattcaaacaattgaccataaggttcaatgtaagcagcgccggtgcacttgcattccagctgaattagagcgacgtgcagcataagccaagtcttcttttgtaatatagccttcttttgttgatgtgtttacggtccattgggtggataatacaaagcgattcgaaattttgatgccattaggtaagtggattgattgtaaaagtggtttgtatcggtacatactatgattccntttccattgcaat

SEQ ID NO: 4045 - DNA, 400 bp; double-stranded, linear
gttccaatgaagatagctagaaatgatatccaaaacacatgatgcatcactggtgatgctcgactaattgtattccatgatgcattaataataatgaccaatacacataaaataagcagccatttatcgtttattttaaaaatataatgcagcaaaaatcccaaaatgattaattgcacaactgctcgtaatgtcgcaacaattaaatctttaataatatgtaaaccttctttatatgaaatgataatcggaatgactaaaagcaatgccgtcaatccaagtgccgtattactcatgtngattcaactcctctgtattagaaatttgaccatcaacaattgttatacgctttttgnaagtggtcgcatactttggggcatcgctgtggggtagggggncn

SEQ ID NO: 4046 - DNA, 375 bp; double-stranded, linear
cgagtctgagtcgctgtctgaatctgaatcgctgtctgagtccgaatcgctatctgaatctgagtcgctgtctgagtctgaatcgctatctgaatctgagtcgctatctgagtctgagtcgctgtctgagtctgagtcgctgtctgagtctgaatcgctatctgaatctgagtcgctgtctgagtctgagtcgctatctgagtctgagtcgctgtctgaatctggagtcgctgtctgaatctggaatcgctgtctggagtctgaatcgctatctgagtctggaatcgctatctgagtctgaatcactggtctggagtccgagtcactgtctgaatctgactgcactnacnggattctgagtcgctaacnggaatc

SEQ ID NO: 4047 - DNA, 400 bp; double-stranded, linear
atgggtaaaaaggcattagagtcaatcattgataacgctgatgaaacaactcaagagcgtttacgttcaggatatgaagatgctgtagattataaccgttatgtcggtaatatttatactggatcattatatttaagcctaatatcattacttgaaaatcgagatttacaagctggtgaaacaatcggtttattcagttatggctcaggttcagttggtgaattttatagtgcgacattagttgaaggctacaaagatcatttagatcaagctgcacataaagcattattaaataaccgtactgangtatctgttggatggcatatggaaacattcttccaaacgttttggatgacggtggaatttgacggnggaccaagatgcntgttccaggaggtcc

SEQ ID NO: 4048 - DNA, 400 bp; double-stranded, linear
caaaccatctgacataatatacacttggatgttagataagggtttgccaattggaatcgtctcaggtatcaatcaccacaatgatgtgaccaatacgatgtgatgactgttgactcagatggtccataggcattgaaatacgtgccacaatgcttctcaatatatttaacaaaggatgccgtactagttgccccgcctgtaatcaacttttcaatataaaagtcttccataacactacacatctgtaacggaatcgacgcaaccgtcacacgatgcttattaatgagttgttgtaactgttctggattaacacgntcctctctatctggantcacaagcgtatgaccattaacaaacaacaataaatctccataactgntgcatcaaaaacatattgcat

SEQ ID NO: 4049 - DNA, 400 bp; double-stranded, linear
tctgcatgttctcgagatccaccaaatgttaaatgggtatgtgcatctactaatgctggggacactaccttcccactagcatcaatcgtctcagtcgcatcgtagtcatctgtatgtgttccagcatatacaattttggccatctttaatgacaactgtaccatttttcacaacatttgaattcatctaattccttacccttcaaaggtttatctgttgatctcggtaaaattaattgctgctatatgattantattaaatcattcattactatcacctgcttatcaatcatggaatagaataccttttcnttagcgtttgaatagcgagtcatagccagcatcaacatgtcgggcaacacccataccggggtcatcgtccaatacacgttccaanctnc

SEQ ID NO: 4050 - DNA, 400 bp; double-stranded, linear
atcacccatgttctgactcccaagttaaattaattggcattcggagtttgtctgaattcggtaacccgagaggggcccctcgtccaaacagtgctctacctccaataatcatcacttgaggctagccctaaagctatttcggagagaaccagctatttccaggttcgattggaatttctccgctaccctcagttcatccgctcacttttcaacgtaagtcggttcggtcctccattcagtgttacctgaacttcaacctgaccaagggtagatcacctggtttcgggtctacgacaaatactaaacgcctattcagctcgnttcgtacggctccacatttactgctaancttgcatcaatcgtactcgcggtcaatctacaaaagnacgcatcaccanta

SEQ ID NO: 4051 - DNA, 400 bp; double-stranded, linear
agtgaaaatgactttatcgggctgttcagcgatatggatttgagttcaacgcgactaggtaacaatgtcaaagaacgtactgctttaatctctaaagtcatggttaatcttgacgacttaccattcgttcacagtgacatggaaattgatatgttaggtgatgcatatgaattcctaatcgggcgctttgcggcgacagcgggtaaaaaagcaggcgagttctatacaccacaacaagtatctaagatactggcgaagttgtcacagacggtaaagatnaattacgtcacgtgtaacgacccaacatgtgggntccggttcattgtggtaacgtgttggtaaagaacgcaagtgtatcgttaattcggacnaagaacgtaacaatactacntacgactta

SEQ ID NO: 4052 - DNA, 390 bp; double-stranded, linear
tcctacaaccccaacaagcaagcttgtggtgttgggctcttcccgtttcgctcgccgctactaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcggcccttaataacttaatcnatgttttccaccattttttataagtncaaaggcttcacatacggcttcggtttttcattaattttaaatggcncaatttaaca

SEQ ID NO: 4053 - DNA, 400 bp; double-stranded, linear
aacataccgatgtatataatctatacacaaaggataattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgattttctatcgcttcttatctgaaaaagccgaacaagaatatgcagatgccttgtcaggtgaagacatcacgtatcaagaagcatgggcagatgaagaatatcgtgaagacttaaaagcagaattaattgatcaaagtcggttacttcattgagccacaagatttattcagtgcgatgatcgtgaaattganacgcangatttccgatataga

SEQ ID NO: 4054 - DNA, 400 bp; double-stranded, linear
gtaagaccatcgtacttgagtcttcaagtgttcttgataaaacggaacgagagacttggtatttttcgaacaaatctttcattaacacaccgaccataataattacaatcgaagcaacacctgcagcgaatacaagcgcaatacaacaaataacagtaatacatattaaacttcctacagaatggatgcctttagaaatagtagttaataagacttctaaacatcctgctttttctacaatacctgcaaatgcatatccgcaaaatatcgttactaatatttgggncatactcatcataccaccctgttctaacaagctttcacactggatgaatatgagntgatgtatcattgatcgttaaaccctaatgtgctttgaaccatcgtcatttgaatgtga

SEQ ID NO: 4055 - DNA, 400 bp; double-stranded, linear
cgtctacaagttcaaaattcaagtcttccataattggtttaacaatcacttctacttgttctgtaattttactcatacaggcctccctttttggcaaatagaaaagagcgggaatctcccactcttctgcctgagttcactaatttttaagcaacttaattatagcataagtttatgcttgaaacaaatgacttcactattaatcagagattcttgtaaaagtttgttcctttatttcaccattacatttgaatagactcgtaagacattgaaaagaaatacgggcataattttgtgtccagcagcaattttgtatttctttgactacggcatacggattaaataaataccttgattatttcattttacatatcaaatatcggaagttgagctttatctg

SEQ ID NO: 4056 - DNA, 481 bp; double-stranded, linear
attttggtttacttcatgttgagttttagacattttaaccatctccaatataaaaataaattaaattaaattctcagggacttgcatgacgccacctgtatttgcgctagttactagggcagtataacgagctagataacctgtttttactttcgctttaaatggtgttaaagattctcggcgacgcgctagaacatcttcaggctggtttacgtttaatgtacgatttgttaaatcaatagtaatctcatcaccatcttcaattaaggcaattggtccaccagatgcagcttcaggggaaatatgaccaactgcaatacctcttgtggcaccggtaaaaacgcccatcagtkaattaatgcaacatctttacctaagccgcgaccaacaatagaggaagtaggtgctaacattttcaggncatacctgggtccaccttttaggtgcctttcantatctnatggacaacgacgtgggcctg

SEQ ID NO: 4057 - DNA, 379 bp; double-stranded, linear
tttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttggacgttttagacataaaaaaaagagaccttgcggtctcaatgcggctcatcgcatccattttttgcctggcaacgttctactctagcggaagtaaattgggctaccancgacgctaagaacctttcttggactgtgacaatcggctgcntctgtncct

SEQ ID NO: 4058 - DNA, 400 bp; double-stranded, linear
ctgcatcactgccataaaaactaccgtcagcagcgatagncggccaatcataccaggaacaagaccgggcttgtcagcgatactaacagcgatatatccagctagtattggaaccataaatttaaaggctaaactaccaatgttttcaatggatttccaaaatgaatcatctgggatgactaatccttttgatgtcgtttcaccgcctagagtcagcgcgatggcgataaggagtccaccaactacgataaaaggaaccataaacgatacaccgttcattaaatgttgatacaccatttgaataccattttagactnaccgcgatctttcgaatgataatttgtttcagatggttaaataggcgcatttgatttaatgatacgtggatttggaccctcgg

SEQ ID NO: 4059 - DNA, 367 bp; double-stranded, linear
ttaaaaaactgcctggcaacgttctactctagcggaactaagtnganctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttggattaagtcttcgatcgattagtattcgtcagctccacatgtcaccatgcttccacctcggaacctattaacctcatcatctttggagggatcttataaaccgaaattggggaaatctcatcttgaggggggcttncatgcttagatgctttccagcacttatcccgt

SEQ ID NO: 4060 - DNA, 374 bp; double-stranded, linear
ttccgnactcacatagcgactcaggattcagacagcgcattcagattcagacaccgcattcagattcagcatagcgattcagcattccgcacagtgactcagnattccgacagtgactcggattcagatagcgattcagattccgacagtgactcagattccgacagtgactcagactcagacagtgattcggattcagcgagtgattcggattcagatagtgattccgactccgacagtgactcggattcagatagcgactcagactcggatagcgactcggattcagatagcgattcggactcagatagcgattcagaatcagacagcgattcagattcagacagcgactcagacagtgactcagattcaga

SEQ ID NO: 4061 - DNA, 432 bp; double-stranded, linear
aaaatcataatatttggcaattttttcaacttgactctggtccttctgcataactgccgtaaataattcaccttcatcacacgctgtacctaccaataatccctcacgatattcatctaacaatgaacgtggaattcgaggtgtacggtagaaatacttcaccaatgatgcacttacaattttaaatagatttttaagaccttgttggttttgtacaattaatgtgacatgactaggtcttgcacgtttatatgcatcttcattactgagtttttkgttgatttcgttatgatttaatacgcctaawtcyttcatttgttgaaccatttttatgaaaatgtaagctgttgcttctgtatcataaatggcacggtgatgttgcgttaattctacgccatattttttagccaagaaattcaaaccatgtttacc

SEQ ID NO: 4062 - DNA, 386 bp; double-stranded, linear
tatcttcgttctcaatagaatgatttaaaccttcgatttctttatctaaatgactaccaattaaatctatttcttctattgttaaatcgctatctccatcttcttttatctctggtattattttttcttcaactaagtcacgatataatgtttttgaattttcgttcaatttcgattcgtgattttgaatacttttcttccacacaaatgtatacctattggcattagcttctacttttgtaccatcaataagattttgctttaaacattgactatgaaactgggataaataaagantcaattaacgcatcagtattagggantcactctaatacgattaatagtttttataagaaggtgnttggatttggagctaaccacatcca

SEQ ID NO: 4063 - DNA, 386 bp; double-stranded, linear
taggagagcgttctaagggcgtagcatgatcgtaaggacatgtggagcgcttaggagaatgccggtgtgagtagcgaaagacgggtgagaatcccgtccaccgattgactaaggtttccagaggaaggctcgtccgctctgggttagtcgggtcctaagctgaggccgacacgtagggcgatggataacaggttgatattcctgtaccacctatgaatcgttttaatcgatggggggacgcataggtataggcgaggtgacgattgggattgcacgtcttaagcagtaaggctgagtattaggcaaatccggtactcgttnaaggcttgagctgtggatggggagaagacatngagtcttcgagttcgttggntttcacaatggcc

SEQ ID NO: 4064 - DNA, 386 bp; double-stranded, linear
taaggcagatgctctcccagctgagctaattctccgatttaaaactgcctggcaacgttctactctagcggaacgtaagttggagctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaacatttattttgattaagtcttcgatcgantagtattcgtcagctccacatgtcaccatgcttccacctcgaacctattaacctcatcatctttgaggggatcttataaccgaagttggggaaatcttcancttgnagggggggcttcatgcctttagaatg

SEQ ID NO: 4065 - DNA, 400 bp; double-stranded, linear
aattctttcgctacttgaatgacaacactttgttttacgcctgaaatggcttcttgccaagcaggtgtatattttgattctgcatcgtcgtatccttttgattctaatttatgatcaaaacgacgcacgccatattgacttgccattaagtcaaaaattgtagcaatacggactttgtcaccatttgctaaagtgacttgtcgagttggaattggacgattgaatatcccatctccatcactatcaaagtatgggaattgaattgtttctaattcgtatccaccttctgtcattgataatgtagggttaattttagaaccatcttctgtttctagttttaagttccacttcttaccttcttcccaacgtggacccatggtgccattangnactactaaac

SEQ ID NO: 4066 - DNA, 400 bp; double-stranded, linear
attttgaaattgagaaaacaacttattgaaaaacataatctttacggtaacatgggttcaggaacaatcgttattaaaatgaaaaacggtgggaaatatacgtttgaattacacaaaaaactgcagagcatcgtatggcagacgtcatagatggcactaatattgataacattgaagtgaatataaaataatcatgacattctctaaatagaagctgtcatcggaaaaacaagaagttaagtgacaacggtttacatgttgcttagcttcttttattatgcgtaatgatgtaaaaagacgnatattcatttgtttgtaaaagtggcattctatgtcttaaagtgacgnaacttccaatgtgcccagtgtttgattcacatcaaatccatttttatttaac

SEQ ID NO: 4067 - DNA, 400 bp; double-stranded, linear
cctcattccaggaaggaatgtattctaagagttgaaatactcccgcattattattaaattatggagcggaagataggatttgcacctatacctcgttccgggaaggaacgtgttctaaaagttgaactactcccgcataaacctggaggcggcaaccggatttgaaccggtgataaaggttttgcagacctctgccttaccacttggctatgccgccaataactgggctagctggattcgaaccaacgagtgacggagtcaaagtccgttgccttaccgcttggctatagcccattaataataagggcggctgaaggggatcgaaccctcgaatgtcggaaccacaatccgatgtgttaaccacttcaccacagccgccatggcaggggcagtaggaatc

SEQ ID NO: 4068 - DNA, 400 bp; double-stranded, linear
tatctaatagttttactttaagtccagcattcacaaaaagtgctgccagttgagcgcccattgtgcctgcgccaagaacggttactttattaattgtcatagtgattcctccaatttagttgaggataagataaccattaagataattggaataacgttgctattttataaaattaattaagtatctttgacagtcatcttagcctcttatttaaggaaaaagctttatgcttaaaataagtcttttttagtgaaattaatgcatctcatataattatttgctatttatacgaaagcagaatctccagtcaaagcgcgtccantactaaggcattaatttcatgtgtacctcgtacgtgtaaatcgnttctgcatcagngaggaaacgtgcaatatcata

SEQ ID NO: 4069 - DNA, 356 bp; double-stranded, linear
caaaggaccaattgcatttgagtatacacatattaataacaataccgaacgtggttggttaaaaagaagaattgaaacgccatataaagtaacgttaaataataacgaaaaaagggcactattcaaacaattagcgtatgttgaagggtttgaaaaatatcttcataaaaacttcgttggtgcaaagcgtttttcaattcncggggtagacgcacttgtaccgatgttacaacgtactattacgattgctgcgaaagaaggtattaaaaatatacaaataggcatggctcaccgtgggacgtttaaacgtttttaacgcatgtncttagaaaaaaccgtacgaaatgatgatttcn

SEQ ID NO: 4070 - DNA, 400 bp; double-stranded, linear
aaacgtttagggaaaattatcacacagatacaacaatacacagatattgattacccgatagcgattgtctttcaagcatcgtgttttaacgagtttgttgttaaggggcgtttaagtaatattatttcaaaattgcaacactattcaattgaggcgaaaccaggtatatgtattataggggaagttgttgattatactgaaaacactcctaaatcatatgatcctatgaagcaattttatgtagtaagtggttctaaacatgacgcccttatgctctgtgaacattatatgacgaaggttatggctgttgctaaaccccaatgatacatcgaatgggcaccattatccantcgtcgcaataatggattacccaaggatgccatttanttaagccngccan

SEQ ID NO: 4071 - DNA, 361 bp; double-stranded, linear
cctctggaaaccttagtcaatcggtggacgggattctcacccgtctttcgctactcacaccggcattctcacttctaagcgctccacatgtccttacgatcatgcttcaacgcccttagaacgctctcctaccattgtccaaaggnatncccacagcttcggtaatatgtttagccccggtacattttcggcgcatgtgcactcgactagtgagctattacgcactctttaaatggatggctgcttctaagccaacatcctagttgtctgggnaacgccacatccttttccacttaacatatattttggggaccttgagctggtggtctggggctgtttcgggaacggaacacgggacctt

SEQ ID NO: 4072 - DNA, 400 bp; double-stranded, linear
atggtgacaaaaacatcgcattattactaggtgtcggcacaggcgtttgtggtgctgctgctattgccgcagtcgctccaatattcaaatcacgtgaaaaggatacagctattagtatcggtatcatcgcattgattggtacgatattttcacttatatatacagctatctacgctatcttttcaatgacgacaaatgtttatggcgcttggtctggtgttagtcttcatgaaattgncacacgttgtcttagctggtggctttggtggtagtgatgcacttaaaattgcacttcttggtaaacttggtaggagtattcttactggattcccattaaccatcgtacttaattttaaatatgcggttnccgttncatcaggantcatctaggcaaggggtc

SEQ ID NO: 4073 - DNA, 400 bp; double-stranded, linear
gcgacgatcattttagaatccgcttgggcgattaattctttagaagtggatgaggcaaaatgttcattatcaggaactaaagcaggtgctgatatgaaagatggtctacgtattcatggtgaagacatgggtacactttataccaaacacgttgaattggaaaacaaaggcgtcgacttttatgaaggtaatgaagtggatgaagctgaagaagaagcaaaagcttggattgatgcagttgtaaatgatactgaaccagttgtgaaccggaacaagcaatggtagttaccanaattcttgaagcgatttatccgtctgccaaatccaggccaaagccatttactttggaataacatcntaccggtaagggggcncatcctggaccaaatttaaaagttgg

SEQ ID NO: 4074 - DNA, 400 bp; double-stranded, linear
tcttcctaatacctttccacgatcttcagctggcgcctctgcactcgcaaacgcacttgatgcatcaacaacaccaccaaatagtccctgcaataacctcacaagtacaaactgtaatggtgtcgtacacaatgccattaaaaataagcataccgccaaaccaagtaacgctcttaacaccatccattttcggctgatcttatcacctagcttcccccatatcggcggagttatgcatcgtcgttacagctggagcagcaatcgctataccactccacanctgtatttctacggactgataggattttgtagtgatgnccatgatgaaatgggcaataatgggcacaagtactgttcagtccagccaatcgttatgaaactggactggggccatnaaatg

SEQ ID NO: 4075 - DNA, 380 bp; double-stranded, linear
ggttcagaacgtcgtatgnagttcgntccctatccgtcgtgggcgtaggaaatttgagaggagctgtccttagtacgagaggaccgggatggacatacctctggtgtaccagttgtcgtgccaacgcatagctgggtagctatgtgtggacgggataagtgctgaaactctaagcatgaagcccccctcaagatgagatttcccaacttcggttataagatccctcaaagatgatgaggttaataggtttcgaggtggaagcatggtgacatntggagctgacgaatactaatcgatcgaagacttaatcaaaataaatgttttgcgacaaatccacttttacttactatctagtttgaatgataaattacatccatatg

SEQ ID NO: 4076 - DNA, 380 bp; double-stranded, linear
caacgactcgaagacacaatgtcttctccccatcacagctcagccttaacgagtaccggatttgcctaatactcagccttactgcttagacgtgcaatccaatcgcacgcttcgcctatcctactgcgtccccccatcgattaaaacgattataggtggtacaggaatatcaacctgttatccatcgcctacgcctgtcggcctcagcttaggacccgactaacccagagcggacgagccttcctctggaaaccttagtcaatcggtggacgggattctcanccgtctttcgctactcacancggcattctcacttctaagcggtccacatgtcttacgatcatgcttnaaggccttaggaaggttcctaccatggtcaa

SEQ ID NO: 4077 - DNA, 370 bp; double-stranded, linear
gcaggtctgactctagaggatncccacgcgcgcaagatttaaatcgaagaaaccagcaacagattcctcaaaatagcgcggcgaacaacgaaacatcaaatagtgcacctgcagctggtaatggtgtagcatcaacgccaccaagtgcaccaagtggcgatactgcaccaaataataatgttacgcaaaataccgcaccaaatagtaataatgcgcctgtatcgactacaccacaaagtacaaggcgggaanaaagatggtcaaagttttgtagatataacaacaacacaagtcagcacagctaacgagaacacacaaaacattacagataaagatgttaaatcaatggaagcggcattaacgggctctt

SEQ ID NO: 4078 - DNA, 351 bp; double-stranded, linear
aaacattttatcaaatggcagaaggacatgtgccaagaccaccagcgatggttgaaacattgacttatattaaagagtttatgaaccaagttgagtcgcatagctagtatgaaacgtggtgtgcgcatgggaactatcaagctttgaagatgtggtactacatgcgttggaattagggatcggtactttatatgaagacgtgctgcttccattaaatgagtgatgcgattttggcatgaaggtcaccttaaatgtacattgttgtaataaaattgcctatnaaatttttagcacataaaataagaggggccaaccattgttaganataacaacggttggctctttaantgt

SEQ ID NO: 4079 - DNA, 400 bp; double-stranded, linear
ttgaagtaactaaattaatattatgttgttcaattaaaagcttcatacaaacctaatctatttgcactccaccgctaacaccgaacacttgtccggttgtataacttgattcttctgacgctaatagcacataagttccacataactcaacaggttgacctgcacgacctaaaggtgttttttgaccaaatgttgggattttactttgaggttgtccaccagaaatttgtaatggtgaccagaatggaccaggcgctacacagttcactctaattccttttggtcctaattcttctgaaaaacttttagttaatgaaataattgctgccttttgaaggggcataatccatgaagaatanggccagggantaaaaccctggacnaaagaagccgtggaaat

SEQ ID NO: 4080 - DNA, 400 bp; double-stranded, linear
tcgttggacacaatctgaaaaataaatagatataaattcgcgagatatattcgtatttatagtaaaattaaataaagagattatataacacgaggagtagtaagtatgaaatttgagaaatatatagatcacactttattgaagcctgagtcaacacgtacgcaaatcgatcaaatcatcgatgaagcgaaacattacaattttaaatctgtatgtgtgaatccaacacatgttaaatatgcagcagagcgactagctgattcagaggtgctcgtttgtacggtaataggattcccattaggtgcgtcgacaactggcaacgaaagcatttgaaacagaagatgcaattcaaaatggtgcagatgaattggacatggtcatccacatcggcgcattaaaa

SEQ ID NO: 4081 - DNA, 359 bp; double-stranded, linear
cgactagtgagctattacgcactctttaaatgatggctgcttctaagccaacatcctagttgtctgggcaacgcacatccttttccacttaacatatattttgggaccttagctggtggtctgggctgtttccctncncgaacacggaccttatcacccatgttctgactcccaagttaaattaattggcattcggagtttgtctgaattcggtaacccgagagggacccctcgtaccaaacagtgctctacctccaataatcatcacttggaggctagccctaaagctatttacggagagaaccagctatctccaggttcgattggaatttctccgcnaccctcagttcatccgctca

SEQ ID NO: 4082 - DNA, 379 bp; double-stranded, linear
tttgacatttagtgtaagcgtnttacaaataaagcgtgttgtttttgaattaaatgcatttcacattagtattcatattatttttaggaggaatttatatgacatttgaaaaagaaacggtcttaaaaacattatttcctgaagatgtacttagtattgctaaaggtttaacagacggtgaagtcgaatttttacaacaagtagattcattggctagaaagtaagtaccgtggaaaatattaatcaacattggatagacgctactgtacccgaggactattttaaagatctggggagaattaaattattttaacaatccattactttacaagggatcgtccaaacgccaaanggcctagtccaactatttncagttttt

SEQ ID NO: 4083 - DNA, 400 bp; double-stranded, linear
ttgaaacagccagaggtgttttatacccaggtgtttcagatatgtatgatgcgaaacaatatgttaagccagtnaataattcttggtcgacaaatgcgcaacatatgaatttccaatttgttggaacatatggtcctaacaaagatgttgtaggcatatctactcgtcttattagagtgacatatgataatagacaaacagaagatttaactattttatctaaagttaaacctgacccacctagaattgacgcaaactctgtgacatataaagcaggtcttacaaaccaagaaattaaagttaataacgtattaattaactcgtccgtgaaattatttaagccgataatacaccattaaatgtncncaatattacccngggtagcgggttttagttccgg

SEQ ID NO: 4084 - DNA, 400 bp; double-stranded, linear
agcatatcgtcgttagtaacgtccttcatcggcttctagtgccnaggcatccaccgtgcgcccttaataacttaatctatgtttccatcctacaggaaacgcgttagtaatcttgtgagtgttctttcgaacatagcgattatttcttatgaattcaagcttatttaaaactctttattcactcggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacattattccgccatctnctgaagaagatgttnccgaatatnatccttagaaaggaggtggatccca

SEQ ID NO: 4085 - DNA, 400 bp; double-stranded, linear
ttacttatctagttttcaatgtacaaataatggtggagactagcgggatcgaaccgctgacctcctgcgtgcaaagcaggcgctctcccagctgagctaagcccccaaataggtattaaattaatggtgggcctaagtggactcgaaccaccgacctcacgcttatcaggcgtgcgctctgaaccagctggagctataggcccattaatttggaatgaacaaacattcaaaactggaatacaatatgtcacgttattccgcatcttctggaagaagatgtttccgaatanatccttangaaaggaggtgatccngccgcaccttccgatgacggctaccttggttgacganttgcaccccaagcatttgttcccaccttcgacggctgagctcctaaaag

SEQ ID NO: 4086 - DNA, 361 bp; double-stranded, linear
gtcattggaaactggagnacttgagtgcagaagaggaaagtggaattccatgtgtagcggtgaaatgcgcagagatatggaggaacaccagtggcgaagcgactttctggtctgtaactgacgctgatgtgcgaaacgtggggatcaaacaggattagataccctggtagtccacgccgtaaacgatgagtgctaagtgttagggggtttccgccccttagtgctgcagctaacgcattaagcactccgcctggggagtacgaccgcaagttgnaaactccaaaggaattgacgggcgcacaagcgtgggagcatgtggtttaattcgaaccaacgnatagaaccttaccaaatcttggac

SEQ ID NO: 4087 - DNA, 400 bp; double-stranded, linear
gaccttgcaggactcgaacctgcgaccgaacggttatgagccgttagctctaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctgacctcctgcgtgcaaagcagncgctctcccagctgagctaaagcccccataaataattacagtatatcgggaagacaggattcgaacctgcgacccctttcccaaaccaagtgcttttaccaagttggtacttccngtataatttaacgggcccgataggagttcggaacccttaa

SEQ ID NO: 4088 - DNA, 400 bp; double-stranded, linear
agctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggaataaatcttttaaggcttataaacgctcatctgacattgtaggaattcatgctttcaaaagacgatatactacgacactcctacgaacttgtcccaagggattacggaaaaggccctaagggttatgttaattggccctaaatttattaaatgcgtttgaaattcagttagttaaaaagtctgtgagtgangggtgtatgggaaagtggttaaaatat

SEQ ID NO: 4089 - DNA, 374 bp; double-stranded, linear
atcgttttagataagacgggtacattacaaatggtcgtccagtcgtgacagattatcatggtgacaatcaaacgctacaactacttgctactgctgaaaaagattctgaacacccattggcagaagccattgtcaattatgcaaaagaaaagcaattaatattaactgagacaacaacatttaaagcagtacctgggccatggtattgaagcaacgattggatcatcaccatatattggttggtaaccgtgaaattaatggctgacaatggatattagcttgcctaagcatatttnnggatggatttaacacattatgaacgagatggtaaaactgctagctcattgctgttgaattattncataacggtatca

SEQ ID NO: 4090 - DNA, 367 bp; double-stranded, linear
aattgaacgtcaaactctgtgacatataaagncaggtcttacaaaccaagnaaattaaagttaataacgtattaaataactcgtcagtaaaattatttaaagcagataatacaccattaaatgtcacaaatattactcatggtagctgtttttgttcggttgtgacagtaagtgacgcgttaccaaatggcggagttaaagcaaaatcttcaatttcaatgaacaatgtgacgtatacgacgcaagacgaacatggtcaagttgttacagtaacaagaaatgaatctgttgattcaaatgacagtgcaccagtaacagtgacaccacanttacaagcaactactgaaggcgctgtatttattaagtt

SEQ ID NO: 4091 - DNA, 400 bp; double-stranded, linear
taatattatattgctagtagttgactgaatgaaaatgcgcttgcaacaagcttttttcaactctagtcaggggccccaacacagagaatttcgaaaagaaattctacaggcaatgcgagttggggtgtgggccccaacacagagaatttcgaaaagaaattctacaggcaatgcgagttggggtgtgggccccaacacagagaatttcgaaaagaaattctacagggcaatgcgagttggggtgtgggccccaacatgagagaaattggattcccaatttctgacagacaatgcaagttggcgggggccccaacacagaagctggacgaaaatccttgaacgaatgaatgtggcaattggcgggggcccaacacagaagntgacgaaaatnctngaacca

SEQ ID NO: 4092 - DNA, 400 bp; double-stranded, linear
gcatttctcataacacaaggaatttcaacaagtccggctactggatcacaaactaaacctaataaattacttatcgctaatgccatagcgtgcccggatgcttctggtgatcctccgaatatagctactgctgcagctgcggccattgcagatgctgaaccaacttcagcttggcagccacctgttgcaccagctacacttgcattgtttgctacgacacgcccaaacaatgctgaagtgaataagaaatcaatcattgctcttctgttaaatcatgtgtttttctaattaaaaagtgcaccgggaatggtanccgagggaancagctgtgggcgttgcacaaataataccccatcgcagcatttgaccttcatttggttgcaatgggaacctttgactg

SEQ ID NO: 4093 - DNA, 354 bp; double-stranded, linear
tgacttacgtactgttcaaccaatcgatgttgacacaattgtagcttcagttgaaaaaactggtcgtgcagttgtagttcaagaagcacaacgtcaagctggtgttggtgcagcagttgtagctgaattaagtgaacgtgcaatcctttcattagaagcacctattggaagagttgcagcagcagatacaatttatccattcactcaagctgaaaatgtttggttaccaaacaaaaatgacatcatcgaaaaagcaaaagaaactttagaattttaatacattttaaaagttaacgaattagcgtattttagtctcattgattaanatgaaatgngntaatttacggaatccta

SEQ ID NO: 4094 - DNA, 351 bp; double-stranded, linear
cgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatatnttacttacttatcnagttttcaatgtacaaataatggtggagactagcgggatcgaaccgctgacctcctgcgtgcaaagcaggcgctctcccagctgagctaagcccccaaataggnattaaattaatggtgggcctaagtggactcgaaccaccgacctcacgcttatcaggcgtgcgctctaaccagctgagctata

SEQ ID NO: 4095 - DNA, 384 bp; double-stranded, linear
attgttgcgactggcacacccgaagatattgctcagacaaagtcatcatatacaggaaagtatttaaaagaagtacttgaacgagataaacaaaatactgaagataaataagattaaaagaagtgaaggatgttataatttatccttcgcttctttttattaatttagtaatgaatagtagaaagaaaagatgcgtaaaaagaattatgttaagatagggtcaatctagagtagttaaacataaatcgaactnggagtgggacagaaatgataaagaatcactaatgatttattatgtagtggttctttgtcattagccacagctatttgtgtacttaaaantaggtatgccagtgtgcactccttgagaggaaatactnattt

SEQ ID NO: 4096 - DNA, 387 bp; double-stranded, linear
ctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtagcttcgcagaaagagccgactcctcttgaaccttccagcaccgggcaggcgtcaccctgatgacatcaccttacggtttagcagagacctgtgtttttgataaacagtcgcttgggcctattcactgcggctcttctgggcgttaaccctnaaagagcaccccttctcccgaaattnacggggtcattttggccgagttccttaacgagnattcgctcggtgcaactt

SEQ ID NO: 4097 - DNA, 400 bp; double-stranded, linear
ccactcacattcacacatcgattcacacaccgcactcagcactcagnataccgcattcagcattcagcacagcgnactcagactcagaacagcgattcagactcggatagcgactcagactcagatagcgactcagattcggatagcgactcagactcagatagcgattcagattcagatagcgattcggactcagacagtgattcagattcagactcagatagcgactcagattctgacagcgattcagactcagacagcgactcagactcagacagtgattcagattcagacagcgactcagattcagatngcgactcagactcagatagcgactcagattcagatagcgattcggactcagacaacgactcagattcagatagcgattcagattcag

SEQ ID NO: 4098 - DNA, 400 bp; double-stranded, linear
tcgtacctgaactactttgtattaaaatagttacaacgatacctgcaataacacctaatactggatttgatgtaaatttgtttaaaatatctcgtagcctgtctcctgctgatgcttgaagcccgtctcccatgatttttaagccgtaaaggaaaatacctaaaccacctaaaaaggagaaaatgacttctgtaaccgacatttccattatttcacctcaaataagctttatatttagattatcgcttataattgtaaatttaatgttaagattaggtaaaattatttaacaatatatgttatttgtatatgacttgtaaaatatcgtcacttattatgtaaattttcagtggtggnaatggccagtttgccaagcactggtttgaccanatggnggcan

SEQ ID NO: 4099 - DNA, 350 bp; double-stranded, linear
atccttttccacttaacatatattttgggaccttacctggtggtctgggctgtttccggaccgaacacggnaccttatcacccatgttctgactcccaagttaaattaattggcattcggagtttgtctgaattcggtaacccgagagggcccctcgtccaaacagggctctacctccaataatcatcacttgaggctagccctaaagctatttcggagagaaccagctatctccaggttcgattggaatttctccgctaccctcagttcatccgctcactttcaacgtaatcggttcggtcctccattcagtgttacctgaacttcaacctgaccaanggtagatcacc

SEQ ID NO: 4100 - DNA, 357 bp; double-stranded, linear
tagaacttgttgccaaacagcatgcttaatttcaatatcttctttgactgcttcgatatataaatcagcatcatcatttaccaagtcatcatcaaaattaccatatgttaaatgactcgctagatttaagtcgaatagtagcggccgtttcttatctgtaattttatcgtaagattttttcgcaatgagatttggatcgtttttgtccactacaatatctaatagttttactttaagtccagcattcacaaaaagtgctgccagttggagcgcccattgtgcctgcgccaagaacggntactttattaattggtcatagtgantccncccatttagttgagggataagataaccatt

SEQ ID NO: 4101 - DNA, 346 bp; double-stranded, linear
taactcaggctggggacataaatcaatattctatgctctacgaattatattggcagtagttgactggncgaaaatgcgcttgtaacaagcttttttcaattctagtcaggggccccaacacagagaatttcgaaaagaaattctacaggcaatgcgagttggggtgagggccccaacacagaagctgacgaaaagtcagcttacaataatgtgcaagttggggatgggccccaacaaagagaaattggattcccaatttctacagacaatgcaagtnggggtgggacgacgngataaattttgcgaaaatatcatttctgtcccactcccatcaaaagaatgacat

SEQ ID NO: 4102 - DNA, 363 bp; double-stranded, linear
aatgatgaaaatcaattagacaaagcaggtaaattaagtgatgtcgcgtcatttaaggaagcgattcacaatcgagaatcacaaagtacaactggtatcggcgaaggtattgccattccacatgccaaagtggccgcagttaagtcaccagctattgcgtttggtaaatctaaagcaggcgtagattatcaaagtttgggatatgcaaccagcacacttattctttatgattgcagcgccagaaggtggccccaaacacattctagatgctttactaaagttgnctggtattttaatgggatgaaaatgtacgtgaggaaattnttacatggcttcatcanctgaagaagtactagcgatcat

SEQ ID NO: 4103 - DNA, 400 bp; double-stranded, linear
gagtgcagcggataacattaaaccgacgacancttttttatgttcaggtttagctgtgtgataaattgcaagtgcggcaccacataagccgaacatcatcgtaataaaacggcctgacataaagcgtgacacacctgaataatacttcgtcacatctggatcaccaagttgagcaaagaagatgttctgcgtaccttgaactaagtgccctttgacttctaaagtaccaccaagtgccgtctgccaaaacggtaagtaaaaaatatggtgtaaaccgagtggacctaacaatcttaagatgaagccataarcaaaagtaccsgttggcacctgttttcgttacaaatccaccaacatgtkaatgccggtttgtatggttggcccaantganaacatcata

SEQ ID NO: 4104 - DNA, 358 bp; double-stranded, linear
aattgagaatttgtcgctatttgtaaattgtatcctggcttaagttggccaaagtgtcttatttttttaaagtatttaaaagtaaaattacatgttaatacgtatattaattggcgagactcctgagggagcagtgccagtcgaagcaggggccccaacacagaagctgacatatagtcacttaacaacaatgtgccggttggggtggctgagacggcaccctaggaagggacccgtcatcaaaaattctatttatagaattttacagtaatgtgccagatgggcatagcgacccattcaatacgantatntgantaaatagagaacagcagtaagatattttctaattgaaaattat

SEQ ID NO: 4105 - DNA, 400 bp; double-stranded, linear
gacgcgttaccaaatggcggaattaaagcaaaatcttcaatttcaatgaacaatgtgacgtatacgacgcaagacgaacatggtcaagttgttacagtaacaagaaatgaatctgttgattcaaatgacagtgcaacagtaacagtgacaccacaattacaagcaactactgaaggcgctgtatttattaaaggtggcgacggttttgatttcggacacgtggaaagatttattcaaaacccgccacatggggcaacggttgcatggcatgatagtccagatacatggaaggantacagtcggtaacacttcataaaactgcggtttgtnaccattacctaatngtcaagggtacggcgttaatgtttgaaggttcccgttccaaggttttttcccgttt

SEQ ID NO: 4106 - DNA, 400 bp; double-stranded, linear
gaagttaagctccttagcgtcgatggtagtcgaacttacgtnccgctagagtagaacgtntgccaggcagttttttaatcaaattttggttaaaaaataaaatggacaagataaaaaaagttattgacttaaatgttaataaaatgtataattaattcttgtcggtaagaaaaatgaacattgaaaactgaatgacaatatgtcaacgttaattccaaaaaacgtaactataagttacaaacattatttagtatttatgagctaatcaaacatcataatttttcatgggagagtttggatcctgggctcaggatggaacgctgggcggcgtgccctaatacatggcaagtcngagcgaacgggacgagaaggctttgcttctcctggatgttaaccggcn

SEQ ID NO: 4107 - DNA, 343 bp; double-stranded, linear
gattgtgccacgcttttaaccgaaatacaacatcatcattgacaatttgttgatttgaaaaatctttctcttcaataaatacatacgtttgcatcgtatgtgctttcatgtaactcaatattggttttaaatgcatttcaggaattaaataatgtttactagaacctgctgtcgctacaagtcctattaccttgtcacgaaacgcattgactggaagtagatcaaacacatttnncaaagcaccagggatggaaagcttgaaaaattggaaaaccaataaaaatcacatcagcctgcattaacgacgtcgttaatttatatacatctcctgtagtatctagnt

SEQ ID NO: 4108 - DNA, 351 bp; double-stranded, linear
atacaaaacaccaggtcgtgaagataaacaatcacaagcggctactgcttcagcaactgaattaccatatgcagtattagaagctatgggtggcaaagcaaacattaaacatttagacgcttgtatcacacgtctacggttgaagttaacgacaaatctaaagttgatgttcctggtttganagatttaggcgcatctggtgtattagaagtcggcaataatatgcaagcaatttttggtcctaaatctgaccaaatcaaacatgaaatgcaacagattatgantggtcaagtagtagaaaatcctactactatggaagacgatnaagacgaaactgttgtgggttggcag

SEQ ID NO: 4109 - DNA, 367 bp; double-stranded, linear
cctttttcaaaatcattggatgcatcgataaatagtacgttgtcgtcttgttggcgacattttttaaatactaaaatacatgttggaatacttgtcccatagaaaatattggctggtaacccaatcacggcttctaagtagttcttttcttctattaaatagcgacgnatcacaccttctgcggcaccacggaataatacaccatgtgggagtacgactgcnatggtaccttcatcgtctaaggtaatgtaccctgtggttgaataaaggcaaaatctgctttgggattttggcgcaactttgcccgtaaccactgaatcgttcatcattttcaaatttttgaatcngctggtccattcgcactgta

SEQ ID NO: 4110 - DNA, 400 bp; double-stranded, linear
gtcgtccgattgaaggatggagtactgtcgcatttgcgaaagactggcaaggaccaccacgtttgcaaaacggaacaagttggttctattttgcaacagaccaatggaaatatgaagagtcaaatgtagatcgtttaaaatctccattagctaaaacagaggagttaaagcatcaacatccagctgattataatgttttagcagctagacttggttggttaccatcatatccacaatttaataaaaatagtttgttgtttgcagaagaagctaaagatgaaggtatagattcaaatgaagcgattttgccacgtgcaattgatgaagtgaatcaaaaccaaacaccatttgccatangaaaatcctgatttggaaaaggatcctnccaaaatccannatt

SEQ ID NO: 4111 - DNA, 400 bp; double-stranded, linear
tcagatgaagctaaaagtaaaggtattacatgtgcaagtgcaggtaatcatgctcaaggtgttgcctatacagctaaaaaacttaatttaaacgctgttatctttatgccagtcactacacctttacaaaaggtaaatcaagtaaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtcnggacaatgttaactttgattatctatttgccgcaattggtggtggcggtttaatttccagtattagtactaac

SEQ ID NO: 4112 - DNA, 362 bp; double-stranded, linear
gcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacactagcgattatttcttatgaattcaagcttatttaaaactctttattcactcggntttgcttgggaaaatctatattttacntacttatctagtnttcaatgtacaaataatggtgggcccaagtggactcgaaccaccgacctcacgcttatcagggcgtgcgg

SEQ ID NO: 4113 - DNA, 363 bp; double-stranded, linear
caggtggttttgcgaaaagtgaagtatggcgtcaaatgatgtcagatatatttgacacagagttagtggttcctgaaagttatgaaagttcatgcttaggtgcctgcgtgctcggacttaaagctgtaggtgacattgaagatttttcaatcgtttcatcgatggtcggtgccacaaacaatcatacgccgattgaagaaaatgtcactgtttaccaagagatcgtatccatttttatcaatttaagtcgttctttaacagagaattatgacaaattgcagatttcaacgccacatatcgctgaaataaaacnccataaatacgncactcaagcatcttagataaagttgtnggccatgctac

SEQ ID NO: 4114 - DNA, 394 bp; double-stranded, linear
ggtctgggcttggttccggttctgggtctggacttggttctggatctggcgttggttctggttctgggtctggacttggttctgggtcaaccggcggccctggagttgggtctttcggatttactgctgaatcaccatcagcacttccaccaccataacgtacaacattctcattattccaaccgaaaatactgtagtctctatttgttacaggatcaacattttcttgaataacctgagtttttaagttcttacctgtattgtcgtaatgcccttctactaatactacatatgttttagtaatatcaccaaattaatactagctacattggatgcncataatagatctattttaaatggnctgtactccttaaggtagagcattggactgcan

SEQ ID NO: 4115 - DNA, 400 bp; double-stranded, linear
ggcgattatattaaaaagccaattacagaatgtagtggtaatgaaatatgccaagaatggctgtatcacttaggtgtatcaactgacaaaattgaagacttagcaaaacatgcatctaatacgattcctgtttatatgccatatatcacatcttatttcatgacgcgtgctatcggcgacagacctttagtcgtcccgcatcaatctcagaacttagcatttattggtaactttgccagaaacagagcgagacactgtatttacaacagaatattcggttcgtactgccagggaagctgtttatcaattactaaatatagatcgtggtattccagaagtcatcaataagtccattggatcttncgcgtncttaatgggatggccatatacgaactggatg

SEQ ID NO: 4116 - DNA, 400 bp; double-stranded, linear
aacatattttaagtaggtgaatgaatggtaaatgaacaaatcattgatatttcaggtccgttaaagggcgaaatagaagtgccgggcgataagtcaatgacacaccgtgcaatcatgttggcgtcgctagctgaaggtgtatctactatatataagccactacttggcgaatgtcgtcgtacgatggacattttccgactgttaggtgtagaaatcaaagaagatgatgaaaaattagttgtgacttccccaggatatcaatcctttaacacgccacatcaagtattgtatacaggnaaattcngggtacgacaacacgattataggttgttaagtgggttaggtattgaaagtggtttggtcngggcgaatgttttccaattgggtaaaaggcccatgg

SEQ ID NO: 4117 - DNA, 389 bp; double-stranded, linear
aataaaaaggaacaaaacgatggctattgatatggacacaaatcataaatagctgctttgttccttttttaatttatatatttanaatacacatattcaagagcctcgagatataagtcaatgtactaggccacacaatttaatattgacagtaattacccgaacgaaaatgcgccccggggccccaacatggggaatttcgaaaagaaattctacagacaatgcaagttggcggggccccaacatagaagctggccaatagttagctttcaataatgtgccagttggggtaagggccccaacacagaagctggccaatagtcagctttcaataatgtgccaagttggggtaaggggcccccaccacagggaatttcgaaagaaatnct

SEQ ID NO: 4118 - DNA, 371 bp; double-stranded, linear
aggtaggactcgaacctacgaccgatcggttaacagccgatagctctaccactgagctactgtggattaatattatgcctggcaacgttctactctagcggaantaagttgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtgcagctccacatgtcaccatgcttcccacctcgaacctattaaacctcancatctttgaaggggatcttatnaaccgaa

SEQ ID NO: 4119 - DNA, 341 bp; double-stranded, linear
gcactattagcccagttagagaaagattgacctaatctatccaaccaatcagccgaccattgaaacagtggtgctaattgcggtgaatacattgactaatccgtcaccaaaaccacctgcagcacttaatagcttgttaaataccgaaacacccgttgtattcatcatattaaagaatcttgaagctacactgctattttcagcccattnaagcacgctttgagacgcttcttccattcctcttgaaataccactaaaaaacggntgtaagctctgcattgcagttttaacagtatttaaaccatttgcaagagttgtgaagntagcggattgattttgct

SEQ ID NO: 4120 - DNA, 400 bp; double-stranded, linear
ggttgagaaaagccaacacagctagggtagtatcccaccagcgcctccacgtaagctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtagcttcgcaganaaacgcacttcctgttaaacctttccagcaccggncaggcgttcaccctnattacatcaacttta

SEQ ID NO: 4121 - DNA, 400 bp; double-stranded, linear
aataaatcttgctttattctttttaccagtaatatctaaatgagttggatatttaactttcgcattaatttcaatattaaattgcgttaccgcgacaagcgcaaacacaacatacataataagattggctaaaaagatatagttaaagctaaattctgcgacaaagccgcccattgcagcaccgacagccacaccaatattttgcgctaagtatatcgcattaaacgtttgtcttccgccatttggccacactgctccagccatagcgtatatcgcaggaataatcattccgccaccaaaccctaacattaccaggccataccagcatacccagggccacccgnggaaggaaattaagtagcggtggtactaccaangaccagtggaaggtnccaattaa

SEQ ID NO: 4122 - DNA, 362 bp; double-stranded, linear
gataactaataaagtttagttaagtattttaataacaagtagtatgtcattctagtagctagaacagatatactacttgtttgtttttgtggaaaattgagtatattcaaaaggataagnacgagaatttcgttattaaactacgaattctcgatttttttatattttaagataggtttatttctgaaaacttaatagaaaggggtttgacaaagctaaagtgaagtttgacggtataaacgcaaattaaatatacttttatagaaaattaactcaggctgggacataaatcaatattctatgctctacggaggtatattggcagtagttgactgaacgaaangcgcttgtnaccagctttt

SEQ ID NO: 4123 - DNA, 352 bp; double-stranded, linear
aattattaaggttgctacatgataaatatccacatgcatttatccacatggttggtttttcgcgaggtggtttacaaggattgttgacatttcaagacttaccagtaacaagttatacaatctggggtggtgtctcagatattgatttaatgtatgaagaacgtgtcgatttaagaggcatgctacgaagaatgattggtcatccgaaaaaagatcgagcgggcatatgaggcacgccaagcgattccaaacattaatganaacagtccgccaatattaattgtacatnggaggggaaagacccagcaagttgggtattncatcatgcgtattattttaagcggaccaacta

SEQ ID NO: 4124 - DNA, 400 bp; double-stranded, linear
aaccaggtgatctacccttggtcaggttgaagttcaggtaacactgaatggaggaccgaaccgacttacgttgaaaagtggagcggatgaactgagggtagcggaggaaattccaatcgaacctggagatagctggttctctccgaaatagctttagggctagcctcaagtggatgattattgggaggtagagcactgtttggacgaggggcccctcttcgggtttaccaatttcagacaaacttccgaatgccaattaatttgaacttnggagttcagaacatgggtgataaggtccntgtttcgnaangggaaacagcccagaccaccagttaaggtccccaaatgtatgtttaagtggaaaagggttttggcgttgccccgacaactaggatgttgg

SEQ ID NO: 4125 - DNA, 400 bp; double-stranded, linear
ggcttattaatcaaaaaatttataaagaatatgtagaaaacttttatttacatcgaggctacacgctacaacagaaaattaaaattttaattagcttatacattgtaataggtttttcaatttatatggtggatgttcttgcagtccgtgtaggattaatcataatggttatcatacaaaccgctgtactctttacatttgtaaaaacattacccaaatcaaatcataaaatagaggagtgattgcccatgtttatggcagaaaatagattacaattacaaaaaggcagtgcggaagaaacgattgaacgtttttacaatagacaaggtattgaaactattgaaggcttccaacaaatgtttgtcactaaaacattaaataccgggatacagccgagtaa

SEQ ID NO: 4126 - DNA, 400 bp; double-stranded, linear
aatctatattttacttacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaagggttactccaccggcttcgggtgttacaaactctcgtgggtgtggacggggcggtgtggtacaangacccggggaacgtnattcancggtagcatggctggatctaacgatttactangcggat

SEQ ID NO: 4127 - DNA, 400 bp; double-stranded, linear
cgaaatttgtagtaaaagatgtgcaaccagcgaaaccaactgtgactgaaacagcggcaggagcgattacaattgcacctggagcaaaccaaacagtgaatacacatgccggtaacgtaacgacatacgctgataaattagttattaaacgtaatggtaacgttgtgacgacatttacacgtcgcaataatacgagtccatgggtgaaagaagcatctgcagcaactgtagcaggtattgctggaactaataatggtattactgttgcagcaggtactttcaaccctgctggatacaattccaagttggttgcaacgccaaggaagcggagagaccagtgaagtgattgagccaccgtaatggttggnttccccagtttgtcggcanccacaaccggaac

SEQ ID NO: 4128 - DNA, 400 bp; double-stranded, linear
gattagtgaaaagttggttgtactattaccgttaaaatttggagattatctgtcgtcttcaagtatgcgttcattaattgatattggcgcaccgtataaccatgtcaaagtaccatttgcaatgcagtcattaggcgcattaaggctaacgcctacgcgttacatgaaaaacggagaacaagcagaacaattattacgtcagcttatagaaaaagatgaagcactagctaagtatgtcatgggttgtgatgaaacagcttggtggtcatatatgggtccagataatgatattttccaagatccattanggccatctaactgttccagctaaggaaagtatccccgaagtggctaagcccaaaaatgattacgccaaccagctagtggtccatnggccagc

SEQ ID NO: 4129 - DNA, 374 bp; double-stranded, linear
agaggtccgttgccttaccgcttggctatagcccaatatatagatggnggaggggggcagattcgaactgccgaacccgaagagcggatttacagtccgccgcgtttaccacttcgctacccctccagcttattcatataatttaataatcaaaatggtggagaatgacgggttcgaaccgccgaccctctgcttgtaaggcagatgctctcccagctggagctaattctccaaaataatgactcctgacgggactcgaacccgtgttaccgccgtgaaagggcgtgttcttgaaccgcttggaccaagggagccatggctccaacaggtgagggactcgaacctnacggaccgattcggttnaacagccggat

SEQ ID NO: 4130 - DNA, 431 bp; double-stranded, linear
tttnacatgcatctgaatctctaattttaaanaaatatgnatataaataagacagtaaaaattaaatttcagttgttgcaatttcttcatctgtaggtacatcatcgttaaggccaacaagtgcttcagaaacatttcgtgaatgataaccgatacgttcaagaacrcsaatcatatcgatatatagtaatccgccttttgttgtacattcaccacgattaaggcgtttaatatgacctttgcgtagtttatgttcaatattaaatgattctctactacgttctacaatttcatcttttttcgttttgtcataaacatctaacatgtcgatggctttatcaaatgactcagcaacatggttggaataanttatccataccgcgttgtgcatctnctggtaatgcgaatatcttcatcatgttggcggtttt

SEQ ID NO: 4131 - DNA, 400 bp; double-stranded, linear
tttagttgaaggcggtgttgtcgcatttgctgtttgttgcggtgcttctactttagttgagggcggtgttgtcgcgtttggttttgattgcggtgcttctattttagttgagggcggtgttgatgtggtgcttccactttaggnaantgagtgttgtcgcgtttgctgcttgcgttgtcgttgtgattacacctgttgttaaaaggcctagtgctaaacttgttttagcaatcgttgttattttcatagttgtatgctccattcgtaattattagatttgttcgatacattcattgaatcatacagctttattatagaggcgtattgctccattcacattaaacctgtntaaccagattggaagcagcgttgaatnaaatgaagaaagccagaagttcgt

SEQ ID NO: 4132 - DNA, 400 bp; double-stranded, linear
ccattcactgtatgtctttggccaccaccttgacgttgttgttgctgttgttgattttgattagcttgttgttgattttgattattttgtgcttgattgttcgcttgattagcgttgttttgatcattatcagattcatctttagtcgctttgtcttgatcctcttttgatttatcactgtctgtagattttgatttatctttagaagcgtctttagatgtgtctttgtctttactttcatcagcattatttttatttgtattcgcgattttattttcttttgtaccattattatgattgtttaatgccatgcctccaaatatcgctaaatgcaccgataaatnagtacagctgcaatgaatggtaacaatactttgggccagncaccgtttttacggtn

SEQ ID NO: 4133 - DNA, 417 bp; double-stranded, linear
ttgaatacttttcttccacacaaatgtatatctattggcattagcttctacttttgtaccatcaataaaaattgaattattatcaataagattttgctttaaacattgactatggaactgaataaataaagattcaattaacgcatcagtattaggattcactctaaaacgattaatagttttataagaaggtgtttgattttgagctaaccacatcattcgaatactgtcatgaagtaatttctctattcttcgaccagaaaatacagattgagtatatgcatataagatgatttttaacatcatttttgggatgataggatgttgcgccacgatgatgtctgaattcatcgaattcgctancgggtaccgttccaccaattccattaacatatcgcggaatatcattttgaggaa

SEQ ID NO: 4134 - DNA, 354 bp; double-stranded, linear
ggtttaatatggacctttgccgtntttatgttcaatattaaatggattctctactacgttctacaatttcatcttttttcgttttgtcataaacatctaacatgtcgatggctttatcaaatgactcagcaacatggttgnaataatttatccataccgcgttgtgcatcttctgtaatgcgnaatatcttcatcatgttggtcgttttaattgagcgacatactcttctgttagctctgctacttttaaaatagagcgattgacatcaaacataactgctaaacgctcaacgtctgccttcgtaatggcttttgtagaaattctaactaaataatttcgaatgctatcattgt

SEQ ID NO: 4135 - DNA, 400 bp; double-stranded, linear
ctgggatcgccacctttaagtctaacaaccttgttatatcgacgcgctgcttccacgatacagtcatttattttttcttgctgaatatgttttgcatacggctttttaccaacatcgataatttcagtagtcaaattcgcatattgtaaaattaacggattcactaatcgatcatatagaatgacatccgcttcacgtattaaacgctcagcctttttcgtcaaataattcggattacctggacccgcacctatcaagtaaaccttgccatattcctctacagacatatatatacggtcccgtctgtaacttctacctcataaacatctacacaaccttcatcaggtctggacaatacctgnattaaacaatttttgatcgtgggggggcaaatacatat

SEQ ID NO: 4136 - DNA, 348 bp; double-stranded, linear
accactgaatcgttcatcattttcaaattttgaatctgctgtccatttcgcactgtatggtgggttcgcaataaccgcatcaaatgtattgcctaaaaaggctggattttccaatgtgtcatcattacggatctcgaagttctcataacgcacatcatgtaataacatattcatgcgtgctaagttgtatgtagtattgntacgttcttgtccgaaataacgatacacttgcgtttctttaccaacacgtaacaacaatggaaccgganccacatgttgggtcgtacacgtggacgtaatttatcnttaccgtgctgtgacaatcttcgccagtatcttagatacttg

SEQ ID NO: 4137 - DNA, 362 bp; double-stranded, linear
aggtggggatgacgtcaaatcatcatgccccttatgatttgggctacacacgtgctacaatggacaatacaaagggcagcgaaaccgcgagtcaaagcaaatcccataaagttgttctcagttcggattgtagtctgcaactcgactacatgnaagctggnaatcgctagtaatcgtagatcagcatgctacggtgaaatacgttcccgggtcttgtacacaccgcccgtcacaccacgagagtttgtaacacccgaagccggtggagtaaccttttaaggagctagccgtcgaaagtggggacaaatgattggggtgaatcgtaacaaggtaagccgtgatcggnaaggtgcggctgggat

SEQ ID NO: 4138 - DNA, 384 bp; double-stranded, linear
acatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactgcattgtctgctaaacgttttcttttataaaaagatttaaacgcgttattaatcttgtgagtgttctttcgaacaccagcgattanttcntgaggaattcaagcctanttaaaaccctta

SEQ ID NO: 4139 - DNA, 400 bp; double-stranded, linear
ctcattatgggacgtgcacaagatggttttcttgatcaagacaaatatgacattattttcaaaacagctgaaaatttagacgtaccgatttatctacatcccgcgccagttaacagtgacatttatcaatcatactataaaggaaattatcctgaagtaactgcggcaacatttgcttgttttggttatggttggcacattgatgtcggcattcatacaatacatctngtntnatctggtatttttgatcgttatccaaagttaaatatgattattggacattgggtgagttatcccatctccttagaacgaatggatgaagcttatccgtgaacatttgaaccaccccggaagcaatacttaaaaataaatttantatcacaccgggtggcatggtacc

SEQ ID NO: 4140 - DNA, 400 bp; double-stranded, linear
caaccacattcgctcggctcaccttagaattctcatcttgaactacctgtgtcggtttgcggtacggrcacctattttctatctagaggcttttctcggcagtgtgaaatcaacgactcgaagactcaatgtcttctccccatcacagctcagccttaacgagtaccggatttgcctaatactcagccttactgcttagacgtgcaatccaatcgcacgcttcgcctatcctactgcgtccccccatcgattaaaacgattataggtggtacaggaatatcaacctgttatccatcgcctaagcctgtcgggctcagcttaaggacccgactaaccccagaaccggaagagccttcctctggaaaaccttagtcaatccgttggaccgggatctcaaccg

SEQ ID NO: 4141 - DNA, 400 bp; double-stranded, linear
catatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacataggcggagtatttcttaaggaatncaagcntatttaaaactcttaatcacncggttttgcnt

SEQ ID NO: 4142 - DNA, 400 bp; double-stranded, linear
gttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcggttcgtcagattcaaacgtttcactcgccaagccattttccttgggttacttttaatttgacgtttaaggcataaaaaaaagagacttgcgggctcaaatgcggntcatcgcatccatttttgncn

SEQ ID NO: 4143 - DNA, 369 bp; double-stranded, linear
tttaaaattgacattattactgaccaaacaagtgcacatgatccgctaaatggatatgtgccacaaggaagcgaaagtattgcgtgaaaaagatccgaaaaaatatgttgaactgtcacaagcttcaatggcaaagcatgttgaattaatgcttggaattccaaaaacgtggcgctgtagcatttgattatggtaacaatattcgtcaagtagccttcaataacggangnataaatgcttttggacttcccaggttttgtaccagcttacattagaccattnattctgtgtaggttaaagggccattccgctttgctgcgttggagtggtggatccaaaagatatcgagcgtgccggatggaggaaatg

SEQ ID NO: 4144 - DNA, 370 bp; double-stranded, linear
ggaaagataaatagcttcatcaatgtcatgcgtcactaaaataatagttgattgcgttttatgttttagttgcactagttgatcctgaagtttataacgtgtaaatgcatctaatgcacctaatggctcatccatcaatataacgttaggcttatgcacatgcgctcgacatagtgccacacgttgtttcatacccccggacagttgctcgggaaaatgctttcccctgtcttctaaatcaactaatttaagctgtgcnttaatctcttcatcactaattttctgttgtaatccaatcctaatgttgtcattaatcgttttccaggcagcaaattatggtgttgaaatagcataaacaancgggagnggc

SEQ ID NO: 4145 - DNA, 370 bp; double-stranded, linear
cgaggtagcaaagaacaaattgcgaaatatgtacctaaattacagtcacatgaactgcgtacatgctttgctttaactgaaccagaacacggttcggacgttgcnggaggtcttgaaacagtcgctgaacgccaaggcgatacttgggttatcaatggtgaaaagaaatggattggtggtgcacatgtatctgatgtcattccagtattcgcagtaaataaagaaactgggcaaaccccattgctttgtagtcagaccagaacaagatgggcgtcgatattgaagtcattggataataaaatcgcacttcggcattgttcctaacgccctaatttnaattaantaatgttcaaagtaggattgaagcggg

SEQ ID NO: 4146 - DNA, 380 bp; double-stranded, linear
tggggtgtttttaccaataaagcgttgcaaggtggcggtagtttaatcgattatggttgccacttgttagctactaggtaaagatatggtgccgcatgaagtctaggaaaaacatataatcaattgagcaaacaaccgaatcaaattaatgattggggaacatttgatcatactaaatttgatgtcgatgatcatgttactagttatatgacatttgccaatcgagcaagcatgcagtttgaatgttcgtggtctgcaaatatcaaagaagataaggttcacgttnttttatcaggaggaggatggcggtatccaatttatttccatttggaaatatatggngccccgttttgggaacncattttttggaaagccaagct

SEQ ID NO: 4147 - DNA, 362 bp; double-stranded, linear
tacttatctagttttcaatgtacaatttctttttagtcaagcgctcgcataagcaatatcactttaaccaaaaaatatttgaatgttaaataaacattcaaaactgaatacaatatgtcacattattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccganttcgggtgttacaaactctcgtggtgtgacgggcggtgtgtacaagacccgggacgtattcacctggcagcttgnctgggtttacnt

SEQ ID NO: 4148 - DNA, 400 bp; double-stranded, linear
caccatacatgcgaaatggacagcagattcaaaatttgaaaatgatgaacgattcagtggttacggcaagcttgcgccaaaatccaaagcagactttgcctttattcaacacatggtacattacctagacgatgaaggtaccatggcagtcgtactcccacatggtgtattattccgtggtgccgcagaaggtgtgattcgtcgctatttaatagaagaaaagaactacttagaagccgtgattgggttacagccaatattttctatgggncaagtattccaacatgtatttagtattaaaaatgtcgccacaagacgccacgtactattatcgatgcatccaatgatttgaaaaggaaaaatcaaaccattaagcgtgccaagcgacgatatngcncta

SEQ ID NO: 4149 - DNA, 400 bp; double-stranded, linear
cagctattgatatcgattaccatactgctgtggatagcgacaggttcacgttggaggatacactgagtcctctgaggaatcaaatccaattgactttgaagaatctacacatgaaaattcaaaacatcacgctgatgttgttgaatatgaagaagatacaaacccaggtggtggtcaggttactactgagtctaacttagttgaatttgacgaagagtctacaaaaggtattgtaactggcgcntgagcgatcatacaacagttgaagatacgaagaatatacactgaagtaatctgattgaatagtggatgaatacctgaagagcatgntcagcacaagaccagtcgaggaatnactaaaaccatcatcatattcncatctggttaggactgaaatggc

SEQ ID NO: 4150 - DNA, 371 bp; double-stranded, linear
aaggacgacattagacgaatcatctggaaagataatcaaagaaggtaataatcctgtagtcgaaaatgttgtctctcttgagtggatcctgagtacgacggagcacgtgaaattccgtcggaatctgggaggaccatctcctaaggctaaatactctctagtgaccgatagtgaaccagtaccgtgcaggagaaggtgaaaagcaccccggaaggagttgaaatagaacctgaaaccgtgtgcttacaagtagtcagagcccgttaatgggtgatggcgtgccttttgtagaatgaaccggcgagttacgatttgatgcaagttaagcataaatgtggagccgtagcagaacnngttntgaataggcgtta

SEQ ID NO: 4151 - DNA, 366 bp; double-stranded, linear
tcagcttttttgatatgtattttataatgtacagctcgttgacnntaattttccttatattaagtgccatcaatacaaaacctagctctcgtttaactttatttattcctcgaactgacattcgagtgaacccaaaatagccttcataaatccaaaagcaggctctacatcaatttttctttgactatagatgtttttcgtttctggttcagaaagcttttgattaatttggactttaaagtattcccaattataattcttcatggattttcttattgggatttcgaatttggtttcatgcattgatgtctcaaagaacatgatggaacagtccancacattccagatagtttggaagtctcgttt

SEQ ID NO: 4152 - DNA, 400 bp; double-stranded, linear
tttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcgggacgtaagtggctaccatcgacgctaagaacctttcctggacttggtggacaatcgcntgcctccttcctcctcctcgggctctcggcttacg

SEQ ID NO: 4153 - DNA, 400 bp; double-stranded, linear
tgatattcctgtaccacctataatcgttttaatcgatggggggacgcataggnataggcgacgtgcgattggattgcacgtctaagcagtaaggctgagtattaggcaaatccggtactcgtaaggctgagctgtgatggggagaagacattgagtcttcgagtcgttgatttcacactgccgagaaaagcctctagatagaaaataggtgcccgtaccgcaaaccgacacaggtagttcaagatgagattctaaggtggagcgagcgaactctcgtttaaggactcgggcaaatggaccccgttacttcggggagangggtgctctttangggtttacgcccagaagagccgcattgaataaggcccaagcgntgttttatccaaaacacggtctctgc

SEQ ID NO: 4154 - DNA, 400 bp; double-stranded, linear
ttttagcaatcattttaacagtcagtcatattaaaggctggctaacgattgttatctngtncagatttgtaagttaagatttcttgtaatgtgtatgcagcaccatatgcttcaagtgcccatacctccatctcaccaaaacgttgtccaccgaattgcgctttaccgccaagtggttgttgtgtaacaagtgaatatggtcctgttgaacgcgcatgtaatttatcatcaaccatgtgcgcaagtttcaacatgtacattacacctactgaaatacggttatcgaatggttcacctgtacgtccatcataaagtacagttttaccatcacgagccataccagcttcttcaattgttggaccatacatcgtcatcgtttgcaccgtcaaatactggtgga

SEQ ID NO: 4155 - DNA, 361 bp; double-stranded, linear
gatccgaagttaccaacaggagagaaagaggaagttccaggtaaaccaggaattaagaatccagaaacaggagatgtagttagaccaccggtcgatagcgtaacaaaatatggacctgtaaaaggagactcgattgtagaaaaagaagaaattccattcgagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaaagaagaaatcacanaagtccagttaatgaattaacagattcggtggcgagaaataccgc

SEQ ID NO: 4156 - DNA, 380 bp; double-stranded, linear
caaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccnggggnaaggtggggatgacgtcaaatcatcatgccccttatgatttgggctacacacgtgctacaatggacaatacaaagggcagcgaaaccgcgagtgcaagcaaatcccataaagttgttctcagttcggattgtagtctgcaactcgactacatgaagctgggaatcgctagtaatcgttagatccagcatggctaacggtggantacgtttcccggggtccttgttacacaccgcccgt

SEQ ID NO: 4157 - DNA, 400 bp; double-stranded, linear
tggagaaggacccaaaaatgttgccgtttcaaggttatgttttacaacatttcgaacttatggatgatggattctgccaagttaaaataactgaagatgtattggagcaattcggtattcagccaaatgaagcatctcagtttgttaatacaattgctgacatcaaaggcttgaaaatatgggtatttgcagtcgatggaaggtaatgaaatcagatgtcgattacgttctaaagggcaattggattattaatgatattgcgcagattttggtggcggtggtcatccgaatgcgtcaggagtttcagtggaccagctggggtgganttgagccacttgctaccagctttacggcaccaaaacttnacttataggaaggggcccattccatccaggtgggc

SEQ ID NO: 4158 - DNA, 351 bp; double-stranded, linear
aaatctctgggatcaaatcttacttacagctccccaaagncatatcgtcgttagtaacgtccttcatcggcttctagtgccaaggcatccaccgtgcgcccttaataacttaatctatgtttccaccatttttataagtcaaacgttaacatgaagttacgttcttttataaaaagatttaaacgcgttattaatcttgtgagtgttctttcgaacactagcgattatttcttatgaattcaagcttatttaaaactctttattcactcggttttgcttggtaaaatctatattttacttacttatctagttttcaatgtacaaataatggtggagactagcgggatcgnn

SEQ ID NO: 4159 - DNA, 420 bp; double-stranded, linear
agttaaaggaacttttaaagtggttggccgccgtnattgccttcctnacctttttgtccttctcttgttactttttctgtccctggtgctaaatcmggattaaatttacgttctttcttgaatggaatytcttctttttctacaatcgagtctccttttacaggtccatattttgttacgctatcgaccggtggtctaactacgtctcctgtttctggattcttaattcctggtttacctggaacttcytctttctctcctgttggtaacttcggatcaaattcgtctcgatgacctggtgttatcgtttctggtccgtattctgttaattcattaatcggatcttttgtgatttcttcttttggttcaccnttnacgaataatnactccagtaaaggattttttaagtgttggtgtcgt

SEQ ID NO: 4160 - DNA, 359 bp; double-stranded, linear
acgataatggtgacgggttacaaagccaacacagctagggtagtatcccaccagcgtcctccacgtaatctagcgctcacgtttcaaaggctcctacctatcctgtacaagctgtgccgaatttcaatatcaggctacagtaaagctccacggggtctttccgtcctgtcgcgggtaacctgcatcttcacaggtactatgatttcaccgagtctctcgttgagacagtgcccaantcgttacgcctttcgtgcgggtcggaacttacccgacaaggantttcgctaccttaggaccgttatagttacggccgccgtttactggggcttcgattcgtagcttcgcagaantaaccactc

SEQ ID NO: 4161 - DNA, 351 bp; double-stranded, linear
attgactaaggtttccagaggaaggctcgtccgctctgggttagtcgggtcctaagctgaggccggnaacggtagggcgatggataacaggttgatattcctgtaccacctataatcgttttaatcgatggggggacgcatagggataggcgaacgtgtcgattggattgcacgtctaagcagtaaggctgagtattaggcaaatccggtactcgttaaggctggagctgtgatggggagaagacattgtgtcttcgagtcgttgatttcacactgccgagaaaagcctctagatagaaaataggtgcccgtgaccgcaaaccgacacaggtagtncaagatgagaantct

SEQ ID NO: 4162 - DNA, 400 bp; double-stranded, linear
ancgtcctgctttgcacgccagaggtcagcggttcgatcccgctagtctccaccatttattttttacacgatgaacattgaaaactgaatgacaatatgtcaacgttaattccaaaaaacgtaactataagttacaaacattatttagtatttatgagctaatcaaacatcataatttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactggggataacttcggggaaccggagccaataccggataatantttgaaccgcatnggtccanaagtgaaagaccggcttg

SEQ ID NO: 4163 - DNA, 342 bp; double-stranded, linear
attttatatatgaaataatctgggacaacattcataaatcttattgtcgtccatttttttaaaataataccaatctcatttttaaattctaaacttggtttcgtataatacgctcttaaatctttaaatttaggatttatttctgttggtacttgttttgtggttggcgattgtggtgtgtctgatttagtagattgcattggttgtggcgtgtttgttgatggaggtgttgtcactttagttgnaaggcggtgttgtcgcatttgctgtttgttgcggtgcttctactttnattgcaggcggtgttgtcgcgtttggttttgnatgcggtgcttctatttt

SEQ ID NO: 4164 - DNA, 400 bp; double-stranded, linear
tcacgacacgagctgacgacaaccatgcaccacctgtcactttgtcccccgaggaagggctctatctctagagttgtcaaaggatgtcaagatttggtaaggttcttcgcgttgcttcgaattaaaccacatgctccaccgcttgtgcggttccccgtcaattcctttgagtttcaaccttgcggtcgtactccccaggcggagtgcttaatgcgttantgccagcactaaaggggcggaaaccccctaaacacttagcactccatcgtttacggcgtggaactaccagggtatctaatcctgtttgatccccacgctttcgcacatcaggtcattaacagaccagaaatcgcttggccangggggtnccnccaaaactttggggatttaacggtaaaaa

SEQ ID NO: 4165 - DNA, 400 bp; double-stranded, linear
taattatttgctatttatacgaaagcagaatctccagtcaaagcgcgtccaattactaaggcattaatttcatgtgtaccttcgtacgtgtaaatcgcttctgcatcagagaagaaacgtgcaatatcataatcgtcagctagtatgccattaccacctgtaataccgcggcccatagctactgtctcacgcaaacgtaaggcattcatcatcttcgccgttgaagttgcaacctcgtcatattcaccatgtgcttgcatattagctaattgagcacatgttgccattgcttgagctaaattancttgcatcattgctagctttcctgtattaacggatattactaatnggttgccgaatgcttacgctcagggacntaacnaagtggcacgtaagcggc

SEQ ID NO: 4166 - DNA, 400 bp; double-stranded, linear
aaagttctttggaaatagtaacgttgaagttgtactcactggtgatacatttgatcactgtttagctgaagctttaacttatacaagtgaacatcaaatgaactttatagatccattcaataatgttcatacaatttctggacaaggtacgcttgctaaagaaatgctagaacaagcaaagtctgacaatgttaactttgattatctatttgccgcaattggtggtggcggtttaatttcaggtattagtacttactttaaaacctattcacctaccacggaaaattataggtgttggaaccttcaggtggcaagtagtatggtatggaatcnggtggtgggtaaataatccnggtngtccacattggccctaataaccgataaaatttggggggccggg

SEQ ID NO: 4167 - DNA, 358 bp; double-stranded, linear
cttataatccacaccctgagcaaacgctncttatgacagagtattaaaataagccgataaagatacacacctttaccgactatttaaaatacacttcaccaattcattttaatttaatggattgaagtaactaaattaatattatgttgttcaattaaaagcttcatacaaacctaatctatttgcactccaccggtaacaccgaacacttgtccggttgtataacttgattcttctggacgcttaatagcacataagttccacataactcaacaggttgacctgcacggacctaaaggtgttttttgtaccaaatgnttggggattttacttngtgggttgtccaccagaaatttgt

SEQ ID NO: 4168 - DNA, 400 bp; double-stranded, linear
tttcttgaccatatggacgtaaagagatgttagcatcacaacgtaaagatccctcttccatcttaacgtctgatacaccagtgtattgaataattgaacgcaatttttctaaatatgcatatgcttctttaggtgaacgaatatctggttcagatacgatttcaattagcggtgtaccttgacggttcaagtcaactaatgaatactcacctttatgtgttgacttaccagcatcttcttccatgtggaagacgagtaataccgattcgttttgtttcaccgtcgacttcgatatcgatatatccattttcaccaattggttgatcaaattgagaanttgagagcttntggnttagctggatagaaatagttcttacggtcaacttagatccgttgcgat

SEQ ID NO: 4169 - DNA, 400 bp; double-stranded, linear
accatgtttgaatgaatccattggaatcattattgaagtaaattaaggaatctataatgttcgttaaataaaactgatcccgttgtgcttcacacccgatagatagggatttacagataaattcaggtctcttccacgtcatatttggacccatcgaaaattcgggttctcaaatcatcgaacataacaaaagaagctaagcaacatgtaggccgttgtcacttaacttcttgtttttccgatgacagcttctatttagagaatgtcatgattattttatattcacttcaatgttatcaatattagtgccatctatgacatctgccatgcgattttcttgtaattttttgtgcaatcaacgtgtacntccacggttttcatttaanaacaatttaccgga

SEQ ID NO: 4170 - DNA, 395 bp; double-stranded, linear
taccgaatcgaagccccagtaaacggcggccgtaactataacggtcctaaggtagcgaaattccttgtcgggtaagttccgacccgcacgaaaggcgtaacgatttgggcactgtctcaacgagagactcggtgaaatcatagtacctgtgaagatgcaggttacccgcgacaggacggaaagaccccgtggagctttactgtagcctgatattgaaattcggcacagcttgttacaggataggtaaggagcctttggaaacgtgagcgctantttacgtggnaggcgctgggtggggatacttaccctaagctgtgttggctttctaacccgcaccanttatcgtggtggggagaccatggtcaagcggggcattttgaatggggggcggttcg

SEQ ID NO: 4171 - DNA, 371 bp; double-stranded, linear
tacattatagctttaatcgtttgaagtatagtttgaaaccagtagtcacagctgttcaaggtcgtgccttaggcggtggctgtgagcttgtactttactcacctattgttgtcgctgcaagtgaaacatatatcggtcttgttgaagcaggtgttggcttattaccgagtggcggtggccttgcagaaatggctgatcgcatattacgcacatcgcataagtttgatgacaaacaagcttccatgacaaaagtactgacgaatatcgcattgcgaangctctacaaatgcctttgaggcacgtcgtatgggtatttaccgtggatacagatacgatnatttccaatacagcacaacgngtcgaagtggcgc

SEQ ID NO: 4172 - DNA, 361 bp; double-stranded, linear
atggtggagatagcgggatcgaaccgctgacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaatngtgccgaggaccngaatgaaccggtacgtgatcattaccgcagattttaagtcctgtgcgtctgccagttccgcancccggactataaaat

SEQ ID NO: 4173 - DNA, 380 bp; double-stranded, linear
gtacagatgcattgttaaacaatcagttgcaacagctgttgaaactggtagagtatctaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttactaactccatcgatgaaacgtttgtaccttatgtagaaaaagctttaggcttaattacagaagaaatggtattncacacccagtgccatggttggttaggaaaagnaatcccaccgttgtang

SEQ ID NO: 4174 - DNA, 400 bp; double-stranded, linear
cgattggattgcacgtctaagcagtaaggctgagtattaggcaaatccggtactcgttagctgagctgtgatggggagaagacattgagtcttcgaagtcgttgatttcacactgccgagaaaagcctctagatagaaaataggtgcccgtaccgcaaaccgacacaggtagtcaagatgagaattctaaggtggagcgagcgaactctcgtttaaggaactcgggcaaaatggaccccgttaacttcgggagangggtgctcttttagggttaacgcccagaagagccgcnttgaatangcccaagcgctgtttatccaaaacacagtctctgctnaaccgtaggggattgtataggggcttacgcctgcccggtgcctggaaggtttaaaagggtggt

SEQ ID NO: 4175 - DNA, 348 bp; double-stranded, linear
agccatggctcagcgaggtaggactcgaacctacgaccgatcggttaacagccgatagctctaccactgagctactgtggattaatattatgcctggcaacgttctactctagcggaacgtaattcgnactaccatcgacgctaaggagcttaacttctgtgttcggcatgggaacaggtgtgacctccttgctatagtcaccagacatatgantgtaatttatacattcaaaactagatagtaagtaaaagtgattttgcttcgcaaaacatttattttggattaagtcttcgatcgattagtattcgtcagctccacatgtgcaccatgcttnccacctcgaacct

SEQ ID NO: 4176 - DNA, 344 bp; double-stranded, linear
catttttttaaaataataccaatctcatttttaaattctaaacttggtttcgtataatacgctcttaaatctttaaatttaggatttatttctgttggtacttgttttgtggttggcgattgtggtgtgtctgatttagtagattgcattggttgtggcgtgtttgttgatggaggtgttgtcactttagttgaaggcggtgttgtcgcatttgctgtttgttgcggtgcttctactttagttgagggcggtgttgtcgcgtttggttttgattgcggtgcttctattttagttgagggcggtgttgantgtggtgcttccactttagggnaagatnagtggtg

SEQ ID NO: 4177 - DNA, 362 bp; double-stranded, linear
cagaaccttgnaatgaatcgcgatggaatatctctatctgnaaacagatttctttttgtccgccaatggccttggaattgtttaaataaatctatttgcgcttctttatcaatgtcataacctaatgcttttaacttctctgagaagcgtgtttaccagataattttcctaatggaagttcagtcgtgcttacaccaacaagttgaggtgtcataatttcatatgtttcacgatgttttaatacgccatcttggtgaatacctgattcatgactaaatgcatttggccaacaattgctttatttctaggcactcgaatacctgcatatcttganattaaatccgaggttttagttcctcgag

SEQ ID NO: 4178 - DNA, 400 bp; double-stranded, linear
ggagctaataccggataatattttgaaccgcatggtaaagntggaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaacttnacggagcaacgccgcgtgagtgatgaaggtcttcggatcgtaaaactctgttattaggggaggacatatgtgtaagtaactgtgcacatttttgacggtacctnatcaggaagccacggtttactaggggcccagaagccccggttaatacgtgggtgggnaagggtttt

SEQ ID NO: 4179 - DNA, 371 bp; double-stranded, linear
gttgtttcagcagcgacacagtgtattccattcttagaaaatgatgactcaaaccgtgcattgatgggtgcgaacatgcaacgtcaagcagtgcctttgatgaatccagaagcaccatttgttggtacaggtatggaacacgttgcagcacgtgattctggtgcggctattacagctaagcacagaggtcgtgttgaacatgttgaatctaatgaaattcttgttcgtcgtctagttggaagagaacggcggttgaacatgaaaggtggattaagatcgctatccattagctaaatttaaacgttcaaactcaggtacatgttacaaccaacgtccaatcgttgccagttgggagatgttgttggnnntac

SEQ ID NO: 4180 - DNA, 344 bp; double-stranded, linear
aaagggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacaactccccaaagcatatcgtcgttagtaacgtccttcatcggcttctaatgccaangcatccaccgtgcgcccttaataacttaatctatgtttccaccatttttataagtcaaacgctcacatacggcttcgttttcattatntnaaatgctcatttacataagtaaactctgctttaaaataatt

SEQ ID NO: 4181 - DNA, 343 bp; double-stranded, linear
ccgtgatcggaaggtgcggctggatcacctcctttctaaggatatattcggaacatcttcttcagaagatcgggaataacgtgacatattgtattcagttttgaatgtttgttcattcaaattaatgggcctatagctcagctggttagagcgcacgcctgataagcgtgaggtcggtggttcgagtccacttaggcccaccattaatttaatacctatttgggggcttagctcagcngggagagcgcctgctttgcacgcngaggtcagcggttcgatcccgctagtctccaccattatttgtacattgaaaactagataagtgangtaaaaatatagattt

SEQ ID NO: 4182 - DNA, 400 bp; double-stranded, linear
cagagccaactcgtatgtgatttgtctgcgccaatgtatgcatcatcaaaagttctggactactacacgcaaacgctggtacattatgatgttccgtaaaccaaattcgcttaaagccaagtcgatctgctaattttgcaagtgtcactgaatcttgcaatgccttttgtgcatccttaccttcatctattaaggcatagtctaatacgcttaatttaaccaatccgtcatctccaaacttatcctgtcatgtcaaaccgacataacattttagcgtcttaataccattccctcttcatatacccacgtatatgataacgttttcaataactttatatctttcgccttatttncttttcatatcatatttcagactacaaatgcatcatagttaattaaa

SEQ ID NO: 4183 - DNA, 400 bp; double-stranded, linear
aaagtatgaaagatggtagtgacgcggttggtgattgggctgtattgaatgcactcattaacacagctgcaggtggttcatggatttcattccatcacggtggcggtgttggcatgggatattcacttcatgcgggtatggttgttgtagcagatggatcagagcgtgctgaaggaagattggaacgtgtattgacgactgacccaggtatggtgttgcccgacatgttgnatgctggctatgacatcgctattcaaacagctaaagaaaaaggtattcanattccaatgattggtgaaagcaggtgataagtaatgaatgatttaatattaatcanatagcagantatttttaccgggtccaacagataaacctttgaagggttaggtattagatgcat

SEQ ID NO: 4184 - DNA, 342 bp; double-stranded, linear
ttccctgtgcatcggcatcactattattagcatgactcaattattggcatcacaatatgtcattgcagttatcattggtttcgtcatatgtgcgataggtaatggtttagtcgcaacacctggacttacgattgcaattttcagtatgcctaatganaaagttggtttagctacaggattatataaaatgagtggtacattaggtggctcctttggtatagcactaagtactacagttttcagtatgttacaactaaactatgcaccaagtgtagctgcaaccgtaacatttatagtcagcattgtattgatgntccttgggtncattgtctgcatacatga

SEQ ID NO: 4185 - DNA, 360 bp; double-stranded, linear
aagcatactctgaagcggtgaacaaaaatagaacagatcacattagacatttacttgaatttaaagcatgtacaccgattgacatcgaccaagttgaaccggtaagtgacattgtcaaacgctttaatacaggggcgatgagttatggatcgatttcagcggaacacatgaaacgttagcacaagccatgaaccaattaggtggaaagagtaatagtggtgaaggtggcganatgcaaaacgttatgaagtacaagttgatggaagcaacaaagtaagtgcgattnaacaagttgcttctgggcgttttggtgtactagtgattatttaccacctgccaaggaattccaattanacttgc

SEQ ID NO: 4186 - DNA, 400 bp; double-stranded, linear
cccaagcggaattctaaaatgatcgtcgctccattcttcattttaataaatccaaacgcagaatcttcaactgtaaattcatctggattccatgaaccccaagcgtttgccgcatgatgctgtttatttaatttatggaatgttgaacccatcactgattctggttcataattatccatcatccataacgttaaatctaaagcgtgtgtaccgatatcgattaatggtcctccaccttggagcttcttcgtctagaaagacaccccatgttggtactgctcgacgacgaatgggcatgtgnctttccgaagttaaatgtctcctaagtcgccacgttggcgctgcctggatggaaaattggacgatctgctcgggaaacgaatttggataaacngatggg

SEQ ID NO: 4187 - DNA, 349 bp; double-stranded, linear
gaatcatctggcaaccncccccaaagaaggtaataatcctgtagtcgaaaatgttgtctctcttgagtggatcctgagtacgacggagcacgtgaaattccgtcggaatctgggaggaccatctcctaaggctaaatactctctagtgaccgatagtgaaccagtaccgtgagggaaaggtgaaaagcaccccggaagggatgtgaaatagaacctgaaaccgtgtgcttacaagtagtcagagcccgttaatgggtgatggcgtgccttttgtagaatgaaccggcgagttacgatttgatgcaangttaagcagtacatgtggagccgtagcgaaagcgangtctga

SEQ ID NO: 4188 - DNA, 336 bp; double-stranded, linear
tggatcctgagtacgacggagcacgtgaaattccgtcggaatctgggaggaccatctcctaaggctaaatactctctagtgaccgatagtgaaccagtaccgtgagggaaaggtgaaaagcaccccggaaggggagtganatagaacctgaaaccgtgtgcttacaagtagtcagagcccgttaatgggtgatggcgtgccttttgtagaatgaaccggcgagttacgatttgatgcaaggttaagcagtaaatgtgganccgtagcgaaacgagtctgaatagggcgtttagtatttggtcgtagacccgaaaccaggtgatctaccctnggtca

SEQ ID NO: 4189 - DNA, 358 bp; double-stranded, linear
caaaggatgttaagaaatacaatttattacccagcatttaataatggtgctatagaaggaattaataataagataaaattaatcaagtgaatttcttttggttacagaaatttcaacaactttaaagcacgtataatgatgattttcagcttgtacaaaggagaaaaaaagaagacaaccaagcccaataatggactggccgcctaataataaaagctctaaaagttgtattttaaaaatagttctttaaattatatacccaccacatttggtggaggacctaaaaaaaagcacttccccaaaaatgggaaagtgcaagtagtgagccntaggagggttcggaccctctnncccctct

SEQ ID NO: 4190 - DNA, 362 bp; double-stranded, linear
tcaccaagttgagcaaagaagatgttctgcgtaccttgaactaagtgccctttgacttctaangtaccaccaagtgccgtctgccaaaacggtaagtaaaaaatatggtgtaaaccgagtggacctaacaatcttaagatgaagccataaacaaaagtaccgatggcacctgttttcgttacaaatccaccaacatgataaatgccggcttgtatgcttggccaaatgaaaaacatcaatacacctaaaaagattgcggcaaatgctgtgacaatagggacanatgtagagccaccaaagaaacctaaatacggtggtaataccatttgtgntatttgttgtgaagtattgcggtcataata

SEQ ID NO: 4191 - DNA, 362 bp; double-stranded, linear
tgatcacccatgttctggactcccaattgaaattgaattgggcattcggagtttgtctggnattcggtaacccgngcagggtcccctcgtgccaaacagtgctctacctccaataatcatcacttgaggctagccctaaagctatttcggagagaaccagctatctccaggttcgattggnatttctccgctaacctcagttcatccgctcacttttcaacgtaagtcggttcggtcctccattcagtgttacctgaacttcaacctgaccaaggtagatcacctggtttcgggtctacgaccaaatactaaacgccctattcagactcgctttcgctaaggctccacatttactgcttaac

SEQ ID NO: 4192 - DNA, 400 bp; double-stranded, linear
cgtgtattatgccttctacattggccattatgaaaacttattatcagggtgctgaacgtcagcgtgccttaagttattggtctatcggttcttggggtggcagtggtatctgttcactcttcggtggtgcagttgcgacaactatgggttggagatggattttcatcttctcaattatcgttgccgtactttcaatgttactcatcaaagggacgcctgaaacgaaatcagaaattaccaatacacataaatttgacgttgcagggctaattgttctagtagtatgttgctaagttaaacgttgtcattactaaaggtgcagcacttggntacacatcattatgggtcttgggttgaatgccaatcggaaattgtagcatcnttaatttcctaaaaggtg

SEQ ID NO: 4193 - DNA, 373 bp; double-stranded, linear
aatcccatggaccctcaaattctttatctaaatagtaccctaatgaagtttttctgtgcatgtgattaatttcatgtaaaccgatgacaccaactagcgttccttcataccaaatgccacactgaaatccattaccatcagcaaattgcaaaagtcctcttttaataaatgcacgcgtatctgatggttgctcagttgcatctacccaaggtaaccattccctaagtgaatttcttgaacgattgactaaattgaaaagcgcttctgtgtcatgagcttctaaaattttaatgttattgttcaatcactttcattccaaacatacnatcacatcctcattcattntcatataatccggnaatgaccatatgat

SEQ ID NO: 4194 - DNA, 348 bp; double-stranded, linear
acaaaggacgacattagacgaatcatctggaaagagaatcaaaggtaataatcctgtagtcgaaaatgttgtctcgagtggatcctgagtacgacggagcacgtgaaattccgtcggaatctnggaggaccatctcctaaggctaaatactctctagtgaccgatagtgaaccagtaccgtgaggaaaggtgaaaagcaccccggaagggaggtgtaaatagaacctgaaaccgtgtgcttacaagtagtcagagcccgttaatgggtgatggcgtgccttttgtagaatggaaccggcgagtttacgatttggattgcaaggttaagcagtaaatgtgggagccgta

SEQ ID NO: 4195 - DNA, 340 bp; double-stranded, linear
aaggcagatgctctcccagctgagctaattctccgatttaaaactgcctggcaacgttctactctagcggaantaagtnggactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcgaacctattaacctcatcatctttgagggatcttataancgagttggg

SEQ ID NO: 4196 - DNA, 331 bp; double-stranded, linear
tttgcaggtggcggtgcgactgcagaagacgttaaattaatgaaagatacagtaggtgctgatgtagaagtaaaagcatcaggtggcgtacgtaatttagaagatttcaataaaatggttgaagcaggtgcgacacgtattggtgcgagcgcngtgttcaaattatgcaaggtttagaagcagattcagattactaatatatatnaatnttgggagtgatagctatgacaagaccatttaatcgtgtacatttaatcgtaatggattcagtaggtattggtgaagcgccagacgcagctgatttttaaagatggaggttcacatactttta

SEQ ID NO: 4197 - DNA, 371 bp; double-stranded, linear
gtagacgtcccgatagccgttacgcatggttacgatgtgtattggtgtcggcatgggtgcagctgctatatttgaatatgtgcgttagaatggttgattttggatgaagcggattcgttttgttattgaatgaagtaggctgaagttgaagccagttgaagttgaagcgggttgaagcaatttcgttttattgaatgaagctgtgtgaaatatagtgattgaacaaaaaaagtggtttaatgggatggtggttatttccgttttagaatttaacatttacacgtctaattttaaatcattgttttaaattttatgaatcgaagccctttggatttaatantattgctaatgcnagtaactnatctgattgt

SEQ ID NO: 4198 - DNA, 400 bp; double-stranded, linear
gcgaccccaaccttggcaaggttgtnattctaccgctgaactacttctgcatatgcgggtgaagggagtcgaacccccacgccgtaagctnagnatcctaagtctagtgcgtctgccaattccgccacacccgcaaatggtgagccatagaggattcgaacctctgaccctctgattaaaagtcagatgctctaccaactgagctaatggctcttccatggtgccggccagaggacttgaacccccaacctactgattacaagtcagttgctctaccaattgagctaggccggcaatatgtaagaataaatggtggagaatgacgggttcgnaccgtcgaccctgtgcttgttaaggcagatggttttcccactggggtaaattttccgatttaaaaatg

SEQ ID NO: 4199 - DNA, 400 bp; double-stranded, linear
atcagttgctgttgcgccttgtggtaatgaatttactagtcgtacaccaataacctctggaattgggaaataagaaggttgtccaagcattccagcttcagcttcaataccaccaacaccccatcctagtacgccaataccatttatcattgttgtatgtgaatcagtaccaactaatgtatctggaaatgcagttttttcaccatctacatcacgaacatgtacaacacttgctaaatattctaagttaacttggtgaactattccagttgcaggagggaactgcattgtaattatcaaatgctttcggttggcccaatttaaaaaactggataacgttcatngttacgttccaattcctaatttccnaattacggttccangagcttctgggattttg

SEQ ID NO: 4200 - DNA, 335 bp; double-stranded, linear
caacctttattggtaaaaacaccccagccaggcactttacgcctacgcatcgcttgtacacgtgctactanaggtttaccaaccacacctgattcaattgcttttttagcagtaattgccacatctgtgtgacgataatgatatgcgacagttaataatttgtgatttttattagccgcttcaatcatgcgatcacactcttccgtcgtcatcgccattggcttttcacacaatacatggcacaccatggttcaatgcntctatagaaagatcagcaggaatttattaggtgtacaaatgacccatcaacaagtttaaacagctcgctaggtgnc

SEQ ID NO: 4201 - DNA, 370 bp; double-stranded, linear
atgatgtggcggtggtgaaatcagaccgatacctggcgttgaccctcttgtcttcgcaatccacggatataccttagtaccaggtaattgaccaccttcaccaggctttgcaccttgcgcaactttaatttgaatttctttggcatgttgtaaataatcactagttacaccaaaacgcccagaagcaacttgtttaatcgcacttactttgttgcttccatcaacttgtacttcataacgttttgcatcttcggcaacttcaccactattactctttccanctaattgggtcatgggctgtgctaacgtttcatgtgcttccgntgnaatcgatccataactcatcggccccgtattaaagcggttggac

SEQ ID NO: 4202 - DNA, 380 bp; double-stranded, linear
cagctagcgacttaccttgacgttttgngtattcattccagctttgtnggaatgagtcgggatataagcatctttagataatgcaccatcaactaatggatatttatgtccagttggagccagaaatcataaacgtcttcagtgtaagcaacagcatcttcatttaatgccaaaatgcttggattagtgcaataaccatcgcaactgngccanaccttgtgttggctcgccgcctgaattcaatccataacgtgctgtatctgtagcaataactaatactttttcattcggtctagttgctaaataatctttagctaattgaattgctggtgttgcagcataacaagcttctttcatttcaaagcagcgtgcaaaaggtt

SEQ ID NO: 4203 - DNA, 400 bp; double-stranded, linear
tgctccatttctcacatttggtatttcaaaggtataccaagtcgtatgggattattacttgacatgtcaccaagagcattagaagaagttatttactttgcttcttatgttgttgtagatccaggtccaactggtttagaaaagaaaactttattatctgaagctgaattcagagattattatgataaatacccaggtcaattcgttgcaaaaatgggtgcagaaggtattaaagatttacttggaagagattgatcttgacgaggaacttaaattgttacgcgatgagttgggaatcagctactgggtccaaagacttactccgtggcaattaacggtttagaagttgttngaatcatcccgtaatccagggtaccaccctccnnggntggatttagga

SEQ ID NO: 4204 - DNA, 329 bp; double-stranded, linear
aaattcttccgccctgtaattccttaaccgcttcaacggcatcgtnaatntcttacatttagataaagatgcattgcaagatatcgtcaacttattattagacgatgtacaagttacattagacaaaaaaggtattacgatggacgtttctcaagatgcgaaagattggttaattgangaaggctatgatgaagaattaggtgcacgtccattaagacgtattgttgaacagcaagtacgtgacaaaattacagattactatttagatcatacagacgttaaacatgtggatatagatgttgaggataacgaattagtcgtaaaaggta

SEQ ID NO: 4205 - DNA, 357 bp; double-stranded, linear
ggtaaacaaaaaacttccctttggaagcgaattatggagcggaagataggatttacacctatacctcgttccgggaagggctgtttctaaaagttgaactactcccgcaaatattaaattatggagcggaagataggatttacacctatacctcattccaggaaggaatgtattctaagagttgaaatactcccgcattattattaaattatggagcggaagtaggatttgcacctatacctcgttccgggaaggagctgtttctaaaagttgaactactaccgcataaacctggtggcggcaaccgnatttgaacccgtgatnaaggttttgcagacctntgcctttaccacttgg

SEQ ID NO: 4206 - DNA, 400 bp; double-stranded, linear
tactttgtgaatccagaaaactttgaggatgtcactaatagtgtgaatattacattcccaaatccaaatcaatataaagtagagtttaatacgcctgatgatcaaattacaacaccgtatatagtagttgttaatggtcatattgatccgaatagcaaaggtgatttagctttacgttcaactttatatgggtataactcgaatataatttggcgctctatgtcatgggacaacgannagcatttaataacggatcaggttctggtgacggtatcgataaaccagttgttcctgaacacctgatgagcctggtgaaattgaaccaatccagggatcagatctgacccaggtcagatctggcagcgatctaatcagnagcggtcagatcgggnaggatcac

SEQ ID NO: 4207 - DNA, 402 bp; double-stranded, linear
aaaaagttgagaaaaatgtttgaatcagcaaacgttgtgcaatcgaaatttccacaccatcaaaacctgctttaatcgcgcgtaatgtagcatcgcngwkactgctgaatgatgctattgattttctcatgagacatggcgataacatcgtgtttcaatcggtgaatgcaatgwcatagggcttggtccatacacctttccaaaatttaaaatggcttgatttgaaaaacgaccagcatgcgctactgggataatagcgaggctaccatgttgtttcatcgtagatcccatgttagttaatccagggatacaaccatcatgatcaatattaaancatatccaaccattgaccataaggtcaatgtaacacgccggtgacttcatccagctgaatagacgcgt

SEQ ID NO: 4208 - DNA, 380 bp; double-stranded, linear
gaagagttgcagcagcagatacaatttatccattcactcaagctgaaaatgtttggttaccaaacaaaaatgacatcatcgaaaaagcaaaagaaactttagaattttaatacattttaaaagttaacgaattagccgtgattttagtctcattgattaaaatgaaatngttaatttacgaaatcttaggagggcaaaaacgtgggcatttgaatttagattacccgatatcgggggaaggtatccacgaaggtgaaattgtaaaatggtttgttaaagctggaggatactatnggaagaagacgatgttttagctggaggtacaaaaccgataaatcagtagtagaaatccccatccaccagcatctggtacnggtaag

SEQ ID NO: 4209 - DNA, 400 bp; double-stranded, linear
aataaacctcaggctattcaatggcatacaaatttaacgaatgagcgattcactactatcgcacatcgtggcgcaagtggctatgcacccgagcatacgtttcaagcatatgataagagtcataatgagttaaaagcatcttatatcgaaattgatttacaacgtaccaaagatggccatttagttgctatgcatgatgaaactgttaaccgtacaacaaatggacacggtaaagttgaggattatacccntgatgaattanaacagttagatgcaggaagttggttaataaaaaatatccnaaatacgccagagcagtattaaaatgctaaagtaccacttaggtggaatttaggacgtattggcccgatgccaacntttatattgaaccaagcacctg

SEQ ID NO: 4210 - DNA, 330 bp; double-stranded, linear
gcccacaaccacaaaggctgtaggctacaaatatggagacggcgggatttgaacccgcgtccaaaggtcctgatacacatctttctacgtgtgtagtttatcgataggtttcgcatcatgaaaagtgataaacaaccaacatgatgctagtttgattaagtttcttctaaacagacttcaaacggcatngttagcatatcctattaaggttgaatcgcgttaacagcacataggaaatgctgttaggcgatgcagagtgcgattaggcagctactgcgaaattattgtntgatttgccagttattatnaactgtgtggtgttgatgacga

SEQ ID NO: 4211 - DNA, 339 bp; double-stranded, linear
aaatcatcttatgactgctttttattatactttacatttctcgtttcgtcagattcaaacgttttcacttcgccaagccatctttctttgtgtttgcttttattttgacgttttagacataaaaaaagagaccttgcggtctcaatgnggctcatcgcatccactttttgcctggcaacgttctactctagcggaacgtaagttcgactaccatcgacgctaaggagcttaacttcngtgttcggcatgggaacaggtgtgacctccttgctatagtcaccagacatatgaatgtaaattatacattcaaaactagatagnaagtaaaagtgattttgc

SEQ ID NO: 4212 - DNA, 334 bp; double-stranded, linear
gcgatggttgaaacattgactgatattaaagagtttatgaaccaagttgagtcgcatagctagtatgaaacgtggtgtgcgcatgggaactatcaagctttgaagatgtggtactacatgcgttgaattagggatcggtactttatatgaagacgtgctgcttccattaaatgagtgatgcgattttggcatgaaggtcacctnaaatgtacattgttgtaataaaattgcctataaaatttttagcacataaaataagaggggccanccattttagactataacaacggttggctctttgaattgtaaaaagaaaaccatacgctatgntatt

SEQ ID NO: 4213 - DNA, 332 bp; double-stranded, linear
ctatgatttcaccgagtctctcgttgagacagtgcccaaatcgttacgcctttcgtgcgggtcgttacccgacaaggaatttcgctaccttaggaccgttatagttacgccgccgtttactggggcttcgattcgtagcttcgcagagtanacccactcctcttaaccttccagcaccgggcaggcgtcaccctatacatcaccttacggtttagcagagacctgtgtttttgataaacagtcgcttgggcctattcactgcggctcttctggggcgttaaccctaaagagcaccccttctnccgaagtttacggggtcantttgccgagtt

SEQ ID NO: 4214 - DNA, 363 bp; double-stranded, linear
cgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttantttgacgttttagacataaaaaaaagagaccttgcggtctcaatgcggctcatcgcatccattttttgcctgggcaacgttctactctagcggaacgtaagttgggtaccatcgacgctaagaaccttcttggantgtggacaacgntgg

SEQ ID NO: 4215 - DNA, 338 bp; double-stranded, linear
actcatcattacaatttggacatacagtctattaaancgtgtgccatttggagtccacttttatttgtattgtatagagagaaataaaaaganaccttgttttacaaggtttctaatacgttatgttatgtaaataacagttaattataccggtggtcggggtcgaaccgacactccacaagtggaacggggattttgagtcccgcgcgtctgccaattccgccacaccggcttaatggtaaacaaaaaacttccctttggaagcaattatggagcggaagataggatttacacctatacctcgttccgggaaggacgtgttctaaaagttgactacc

SEQ ID NO: 4216 - DNA, 400 bp; double-stranded, linear
acggtgatcccataatgcttgaacatcaatttcatccattaatgttacatgaggtgcagtatgcttagagttaaccattgctttcgcaattgctctacgcatagcagggattttttcagttgtttctgggaagtcgccttctaatgttactgctgcaggtgctgcaggagtttcagcaacttcttcacttgtagctgaagcagctgattcatttgaagctgttggtgcaccaccatttaagtatgcatctacatcttcttttgtaatacgaccatttttaccagatccagaaactgctttaatgntaacacctntttcacgtgcgtattacgactgaaggcatgccttaacagtcnggttcaccactctcagttgagagcacagggctgcncgctggcgc

SEQ ID NO: 4217 - DNA, 345 bp; double-stranded, linear
agggaatcgaattttctttctcttcctccgggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgtnctttcgaacataggcggattatttctnatgaattcaagcttatgtgaaaactcntta

SEQ ID NO: 4218 - DNA, 345 bp; double-stranded, linear
ggcgccctcgtgccaaacagtgctctacctccaataatcatcacttgangctagccctaaagctatttcggagagaaccagctatctccaggttcgattggaatttctccgctaccctcagttcatccgctcacttttcaacgtaatcggttcggtcctccantcagtgttacctgaacttcaacctggaccaagggtagatcacctggnttcgggtctacgaccaaatactaaacgccctattcagactcgctttcgctgacggctccacatttactgcttaaccttgcatcaaatcgtaactcgccggttgcattctacaaaaggcacgccatgcacccatta

SEQ ID NO: 4219 - DNA, 367 bp; double-stranded, linear
tcttatgactgctttttattatactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaacgtaaagttcgnactaccatcgacgctaaggagcttaacttctgtgttcggcatgggaacaggtgtgacctccttgctatagtcaccagacatatggaatgtaaattatacattcaaaactagatagtaagtaaagtggntttgcttcgcaaaccnttattttggttagtcttcgtc

SEQ ID NO: 4220 - DNA, 342 bp; double-stranded, linear
aagagcctttcttgacttgtgacaatcgcttgcttctttcctctccttcggctctcacttactcatttagctctactaaactcgttgcgttcttttctcgtttcgtcagattcaaacgttttcacttcgccaagccatttttctttgtgtttgctttttattttgacgttttagacataanaaaaagagaccttgcggtctcaatgcggctcatcgcatccattttttgcctggcaacgttcactctagcggaantaagtcgaactaccatcgacgctaaggagcttaactttctgtgttcggcatgggaacaggtgtgacccccntggctatagtcaccag

SEQ ID NO: 4221 - DNA, 337 bp; double-stranded, linear
accggatgacagccccaggatgcgatgagccgacatcgaggtgccaaacctccccgtcgatgtgaactcttgggggagataagctgttatccccggggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaaccttttgagcgcctccgttaccttttangaggcgaccgccccagtcaaactgcccgcctgacactgtctcncaccacgataagtggcgng

SEQ ID NO: 4222 - DNA, 361 bp; double-stranded, linear
ggcgcttgactaaaaagaaattgtacattgaaaactagataagtaagtaaaatatagattttaccaagcaaaaccgagtgaataaagagttttaaataagcttgaattcataagaaataatcgctagtgttcgaaagacatccaccaagnttaataacgcgtttaaatctttttataaaagaaaacgtttagcagacaatgagttaaattattttaaagcagagtttacttatgtaaatgagcatttaaaataatgaaaacgagccgtatgtgagcgtttgacttataaaaatggtggnaacatagattaagttattaagggcgcacggtgggtgccntggcacttagaagccgctgaagg

SEQ ID NO: 4223 - DNA, 400 bp; double-stranded, linear
cggtagaatacaaccttgccaaggttggcgtcgcgggttcgaatcccgtcttctgctccattattttgccggggtggcggaactggcagacgcacaggacttaaaatcctgcggtgagagatcaccgtaccggttcgattccggtcctcggcaccattttagcgcccgtagctcaattggatagagcgtttgactacggatcaagaggttatgggttcgactcctatcgggcgcgccatttttaaattaattgaataacgggaagttagctcagcttggtagagcacttggtttggggaccaagggtcgcagttcgaatcctgtcttcccgattactcntaantccatttangggggctagctcagtggggagagcgctgcttgcacgcaggaggtcacg

SEQ ID NO: 4224 - DNA, 400 bp; double-stranded, linear
cataatatactcttaagtgtaaaggggaatttcctgggtaataattcgcgtgtgcaccttgagtgacttctaccattttatagtcaaattgctttagttcgtttggtttaacgccgacactcgcaaatgtataatcaaagaacttcacaatattgttgcctaagaagcctttgaattcaatagtgtcatttccagcaatttgttcggcaacaatacttgctgcacgggtgagcgcccccagncaaaaggaccactagccggtagaatcgacatgtcgataatgtgatggttgccaataatcgcctattgcataatgtttggaccattggttccaaatttatcgttaccggtatgaaacctttcgatccagttggataattgaacttcgnaaatttgattg

SEQ ID NO: 4225 - DNA, 328 bp; double-stranded, linear
gggttcaatttctgcataccaatcgatgccagctctatttctgacaatatccatatattttgaaattttctctaattctttgccactaaccttttcaccattcaaccaaaattgatcctgtgttaactggtcgttaaaagtgactttcgtttcagtgtaaaatttttctaatgtaacagatatgctattattcattggaatgattagtgcttcatcttttttaccccaatattttatnagtgcaatattcgtatgtgcacgtgctttgccactnntaatcaacgcattaacctcctaaattctcaatccaagtatgtgctgcaccagc

SEQ ID NO: 4226 - DNA, 325 bp; double-stranded, linear
tgacgggttcgaaccgccgaccctctgcttgtaaggcagatgctctcccagctgagctaattctccgatttaaaactgcctggcaacgttctactctagcggaangtaagttcgnactaccatcgacgctaaggagcttaactnctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacct

SEQ ID NO: 4227 - DNA, 331 bp; double-stranded, linear
gcgcaactcacacaacaaggtggcaatcactctgaacaaagtgcggcaanttnttcaacaagcagcacacaacaagggcaacaaggtggcaacggcaattatttagaacaaattggtcgtaaccttacgcaagaagcacgtgacggtttattagatccagtcattggtcgtggataaagaaattcaagnaactgctgaagttttaagtagacgaactaaaaacaatcctatattagttggagaagctggtgttggtaaaactgcgattgttggaaggtttagcacaggcaatcgttggaaggaaatgtaccagcagcaatcaaagacaaag

SEQ ID NO: 4228 - DNA, 333 bp; double-stranded, linear
agaggtccgttgccttaccgcttggctatagccattaataataagggcggctgaaggggatcgaaccctcgaatgtcggaaccacaatccgatgtgttaacncttcaccacagccgccatggcaggggcagtaggaatcgaacccacaccaaagttttggagacctctattctaccgttgaactatgcccctattaaaaataataaatggaggggggcagattcgaactgccgaacccgaagagcggatttacagtccgccgcgtttanccacttcgctacccctccataaatggtgccggccagaggacttgnaacccccaacctaatggtt

SEQ ID NO: 4229 - DNA, 400 bp; double-stranded, linear
ctcttactttgtaaaccaaatcttaaattaaaatattgaaaatgcaatgnatccttaatattttattaaacctataattacttattaaaaataacacacaatattcataaagttttaaaaatattctgttttatcacctactattagtggaaaagtacaattgcaattgtatatagtttgcataacgcttcaaaagtaatttcttttttgtttagttcaaaaaaatttagaggtgatgttatatgaataacggttttttcaatagcgactttgattcaatttttcgaggatgatgaaagatatgcaaggttcaaatcaagtcggaaacaaaagtactatattnatggtaaggagtttcacctgaggactggcgcaactncacacaccaggtggccatcac

SEQ ID NO: 4230 - DNA, 339 bp; double-stranded, linear
cattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaggatccactcaagagagacaacattttcgactacaggattattaccttctttgattcatctttccagatgattcgtctaatgtcgtcctttgtaactccgtatagagtgtcctasaaccccaacaagcaagcttgttggtttgggntcttgccgtttcg

SEQ ID NO: 4231 - DNA, 349 bp; double-stranded, linear
gaagtcatatgcatacacttggttatcattattcatacgttcaatcgcatctgttaactgaatttcgttacctgcgccttctttttgcgtttttaaataatcgaaaatttcaggcgttaatacataacgtcccataatagctaggnttgatggtgccgtaccttgtgctggcttttcaacaaactttttcacttcagactgacgtccgtntttagttaatgggtcaataattccataacgatgagtatctgcttccggaacttcttggacacctataactgagtgccctgtntcttcataaacgtcaatcaactgtttcactgctggcacttcagagtcaacaatatcg

SEQ ID NO: 4232 - DNA, 377 bp; double-stranded, linear
cccagctcgcgtaccgctttaatgggcgaacagcaagcgcctgtgggancgactacagccccaggatgcgatgaccgacatcgakgtgccaaacctccccgtcgatgtgaactcttgggggagataagcctgttatccccggggtagcttttatccgttgagcgatggcccttccatgcggaaccaccggatcactaagtccgtctttcgaccctgctcgacttgtaggtctcgcaktcaagctcccttatgcctttacactctatgaatgatttccaaccattctgagggaactttgagcgcctccgttaccttttaggaggcgaccgcccagtcaaactgcccgcctgacactgtctcccaccacgataaggtcg

SEQ ID NO: 4233 - DNA, 355 bp; double-stranded, linear
ggctagcctcaagtgatgattattggaggtagagcactgtttggacgaagggcccctctcgggttaccgaagttcagacaaactccgaatgccaattaagtttaacttgggagtcagaacatgggtgataaggtccgtgttcgaaagggaaacagcccagaccaccagctaaggtcccaaaatatatgttaagtggaaaaggatgtggcgtggcccagacaactaggatgttggcttaggaagcagccgtcatttanagagtgcgtaatagcgcactagtcgagtgacactggggggaaagggtaccggggctgaacatattaccgaagctggtgggttgtcctttggacanttn

SEQ ID NO: 4234 - DNA, 400 bp; double-stranded, linear
atccgcctcccgcaatattttataggtctcgtagtgtagcgnttaacacgcctgcctgtcacgcagagatcgcgggttcgattcccgtcgagaccgccatcattacatttttattatggttcagtagctcagttggtagagcaatggattgaagctccatgtgtcggcagttcgactctgtcctgaaccatttcttagccggcctagctcaattggtagagcaactgacttgtaatcagtaggttgggggttcaagtcctctggccggcaccatttatggaggggtaacgantgggctaaacgcggcggactgtaaatccgctccttcggggttcggcagttcgaatctgccccctccaattaataattttaataaggggcatanttcaacggtanaata

SEQ ID NO: 4235 - DNA, 341 bp; double-stranded, linear
atgccatgttcaccttgtttaaaatcaaggtttgtaatgtttccttgtgtcacgataataggcgtaatatcactctttgcatgattgcggatgtagtctaaatcaaagttgattaataaatcaccttctttaactnnttgaccttcctcaacatgtaaagtaaagccttctccgtttaatttaacagtgtctaaaccgatgtggattaatagttctaaaccactatctgatacaagaccaattgcatgntttgttgggaaaatcatttgtactttaccgttgaatggtgcacgaacttcaccttgtgaggtttgatagcgataccgtcacccatgcatttt

SEQ ID NO: 4236 - DNA, 400 bp; double-stranded, linear
gttgatgcagcccgttgagctctaaaccaactgagctaaaggtcctaaatataattttacaactaataaatagtggcggtggaggggatcgaacccccgacctcacgggtatgaaccgtacgctctagccagctgagctacaccgccttatatagtttgtaaataatatggtggagactagcgggatcgaaccgctggacctcctgcgtgcaaagcaggcgctctcccagctgagctaagcccccataataattacagtatatcgggaagacaggattcgaacctgcgaccccttggtcccaaaccaagtgctctaccaagctgagctacttcccgtataattaacgngcccgtaggagttgaacccatgaacctnttgatccntagtncaaacggtcta

SEQ ID NO: 4237 - DNA, 376 bp; double-stranded, linear
nanttcttgacctgacatcacctgaaattgaatggacatggtccaccaggtcatatactctaatccatgggtcgccgataccttcaacgnacaacatctacaccactatttctaatacagaatctttctcctgcactaccgttaataaatgccttaccacttgtcgcaccatagaatgagacgttaccagcaataatttcattttgtcgttcttcaaaaggtgctttgacaatgaccgtaccaccagataatcctttaccaacatagtcattcgcatctccagtatgatgaatcattaagcctttcggtgcatatgctgcaagactttgaccagcatgaccattcgtataaacattaattgtattttcaggaagtc

SEQ ID NO: 4238 - DNA, 335 bp; double-stranded, linear
cgatttaaagctaagcccattttcgctctttctccatagcctaaccaagcaatacgtgatggtagtccttgatatgaaattttttcttcagctaaatcaagccatcttaataacttttcattttctgggaaaagtttgcgcatttcttcatccgcacgctcgatatcttttggatcaccactcaacgcagcaaagcggaatggccctttaccttcacagaataatggtctaatgtaagctggtacaaaagctgggaagtcanaaagcatttttcactccgtattgaaggctacttgacgatatgntaccataatcaatgctacagcgccacgttg

SEQ ID NO: 4239 - DNA, 348 bp; double-stranded, linear
ccacanttacaagcaactactgaaggcgctgtatttattaaaggtggcgacggttttgatttcggacacgtagaaagatttattcaaaacccgccacatggggcaacggttgcatggcatgatagtccagatacatggaagaatacagtcggtaacactcataaaactgcggttgtaacattacctaatggtcaaggtacgcgtaatgttgaagttccagtcaaagtttatccagttgctaatgcaaaggcgccatcacgtgatgtgaaaggtcaaaatttgctgttggacggatgcgatgaactacattacatttgtccantacaacacagatngtatcactgcagc

SEQ ID NO: 4240 - DNA, 395 bp; double-stranded, linear
ttgatgttaaagatttagcaaggggcgagagaactggagaagaggttgccaaacgaatggaacgtgcttctgtattggcccaagtagatattcatcgtgcagcaacacataataaaggtgttatgaatggcatacatgctgttgttttagcaacaggaaatgatacgcgtggtgcagaagcaagtgcgcatgcattacgcgagttcgtgacggacagtatcgtggtattgctacatggcgttacgatcaagatcgttcaacgatttgattggtacattggaagtgcctatgacattggcaatcgttggcggtgggtacaaaagtattaccaattgctaagccttcattaggagntactaaatggtagagtccgccccaagaattangnccctgta

SEQ ID NO: 4241 - DNA, 331 bp; double-stranded, linear
actaatgatttattatgtagtggttctttgtcattagccacagctattgtgtacttaaaaataggaatgcatgagtgcaactctanangnagcatactaatttctaaagaaaaagtatttctttatgttggggccccgccaacttgcattgtttgtagaatttcttttcgaaattctttatgttggggccccgccaacttgcattgtttgtagaatttcttttcgaaattctttatgttggggccccgccaactaattccaatatatcattgtagagcttaggtcattgatttttggctcggacttttatggcgatatgaaccatgtaaat

SEQ ID NO: 4242 - DNA, 389 bp; double-stranded, linear
tgcattgcattattgtactgcgtaattgtacctggctttttaccttcagtgcttactggatcatctaaatgatttttagctgtgattaactcacgtttatccgcttttgtgaaaatggactcttgtacttcttcagtactaccatcattgtaagttactgtcacaggaatcgtcgttgtgctaccaccagctaaattagtaggcattgctgtgccatttttaatcgttgcagtacgtttattagcaacttgaactgcattgttaatttcagctgctgttacatttgaaccataatctttcacaattncagttgtgttgacagatgagnggcggtgcagtaaggactggatacactacgagtgaccggactgcttcgggnaatgtgatga

SEQ ID NO: 4243 - DNA, 322 bp; double-stranded, linear
atacgcatgttaacgatcgaatgcttaatgtcccgggaaataaatctatcataagttactttaatgaagttgtctcacgacaaggtaatcatgttgcgctatcatgaatgatttgacaatgacgtatgaacattacgcaactatgtggatgccattgcgcacatgctcctatcaaatggtgtgggcaatggtcaacgggttgccttgtttacagaacgtnttttggaaatgattgcggcgatgttggcgacagttaaagtaggtgcatcttatatacctatcgatattgattttccgaataaacgacaaggtgcaattttgg

SEQ ID NO: 4244 - DNA, 339 bp; double-stranded, linear
gccgactactgaagggnaatcgnaattttctttctcttcctccgggggactaagatgtttcagttctccgggtgtgccttctgtatatgctatgtattcacatatcgataacatgacataactcatgctgggtttccccattcggaaatctctggatcaaagcttacttacagctccccaaagcatatcgtcgttagtaacgtccttcattggcttctagtgccaaggcatccaccgtgcgcccttaataacttaatctatgtttccaccatttttataagtcaaacgttaacatgaagttacgttcttttataaaaagatttaaacgcgttattaatc

SEQ ID NO: 4245 - DNA, 358 bp; double-stranded, linear
ccattaacgggctctgactacttgtaagcacacggtttcaggttctatttcactccccttccggggtgcttttcacctttccctcacggtactggttcactatcggtcactagagagtatttagccttacgagatggtcctcccagattccgacggaatttcacgtgctccgtcgtactcaggatccactcaagacagacaacattttcgactacagggattattaccttctttggattcatctttccagatgattcgtctaatgtcgtcctttgtaactccgtatagagtgtcctacaaccccaacaagcaagcttgttggtnttgggcnacttcccggtttcggttcggccgcnaa

SEQ ID NO: 4246 - DNA, 338 bp; double-stranded, linear
aaagagaccttgcggttagatgcggctcatcgcatccattttttgcctggcaacgttctactctagcggaacgtaagtnganctaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaacatttattttgattaagtcttcgatcgattagtattcgtcagctccacatgtcaccatgcttccacctcggaacctattaacctcatgcatctttgaggggngcttgataaccga

SEQ ID NO: 4247 - DNA, 331 bp; double-stranded, linear
ccccgggtagcttttatccgttgagcgatggcccttccatgcggaaccaccggatcactaagtccgtctttcgaccctgctcgacttgtaggtctcgcagtcaagctcccttatgcctttacactctatgaatgatttccaaccattctgagggaactttgagcgcctccgttaccttttaggaggcgaccgcccagtcaaactgcccgcctgacactgtctcccaccacgataanggcgggggttagaaagccaacacagctagggtagtatcccaccagcgctccacgtaactancgctcacgtttcaaagntctacctatcctgtaca

SEQ ID NO: 4248 - DNA, 371 bp; double-stranded, linear
ataatcatacagatggcaatacaacagcaactgagacagtgtcaaacgctaataataatgatgtagtgtcgaataataccgcattaaatgtaccaactaaaacaaatgaaaatggttcaggaggacatctaactttaaaggaaattcaagaagatgttcgtcattcttcaaataaaccagagctagttgcaattgctgaaccagcatgctaatagaccgaaaaagagaagtagacgtgcggcaccggcagatncctaaatgcaacttccagccagatccagcggctgcagcggtanggaaacggtggtgccaccagtttgccaatttacagcgcccatattacgccaacaactggtnccctaatgcccaat

SEQ ID NO: 4249 - DNA, 357 bp; double-stranded, linear
aattgcatggcataacatcggcgattaaaagatggacgttttgatgatgtacaacaagacattgaagcagtggtgaaagctgcgaaggtcacacagtaaaagtgattattgagacggtattgttggaccatgacgaaattgtaaaagcgagtgaattaacaaaagcggctggtgcggacttcgttaaaacttcaacaggttttgcaggtggcggtgcgactgcagaagacgttaattaatgaaagatacagtaggtgctgatatagaagtaaaagctcaggtggcgtacgtattntagaagtttcaatgaanggttgaagcaggtgcgacacgtantggtgcgagcgcagcgttcaa

SEQ ID NO: 4250 - DNA, 352 bp; double-stranded, linear
gagcccaaaccaacaagcttgcttgttgggngttgtaggacactctatacggagttacaaaggacgacattagacgaatcatctggaaagatgaatcaaagaaggtaataatcctgtagtcgaaaatgttgtctctcttgagtggatcctgagtacgacggaacacgtgaaattccgtcggaatctgggaggaccatctcctaaggctgaatactctctagtgaccgatagtgaagnagtaccgtgagggaaaggtgaaaagcaccccgggaaggggaagtgaaatagaagctggaaaccggtgtgcttacaaggtagtcanagcccgttaatgggtgatggcgtgcctttt

SEQ ID NO: 4251 - DNA, 331 bp; double-stranded, linear
catttactgcttaaccttgcatcanatcgtaactcgccggttcattctacaaaaggcacgccatcacccattaacgggctctgactacttgtaagcacacggtttcaggttctatttcactccccttccggggtgcttttcacctttccctcacggtactggttcactatcggtcactagagagtatttagccttaggagatggtcctcccagattccgacggaatttcacgtgctccgtcgtactcaggatccactcaagagagacaacatnttcgactacaggattattaccttctttgattcanctttccagaatgattcgtctaatg

SEQ ID NO: 4252 - DNA, 400 bp; double-stranded, linear
tatttgatattttgtgcattgcagtcaaaccatggcggaaattgaaccaataccattgctaattttttctgtgtatgtaagggctctaacatattcttaaattgatcaaatagttctngccttgtatctgcaaatgttttgtagtctgcatgcaatgtgagtgcttgatgaattttgaccacaaattcaaatgtatcaggcgtttcttttatccatttcaatatatttctttccggttgtatcgcatagtatgtcgcatctaattcgcaaccggaaaatgtccagcatatgttttaaggttatcggtttggcgttctaaatctgcatataatgaatagtgatcaccccaacctgttaaatccgatggttatccanatgatgatcaccatgtcatcanacc

SEQ ID NO: 4253 - DNA, 327 bp; double-stranded, linear
aaaggtatcaaagatgttaaagttactttattaaatgaaaaaggcgaagtaattggnacaactaaaacagatgaaaatggtaaatactgctttgataatttagatagcggtaaatacaaagttatttttganaagcctgctggcttaaacacaaacagttacaaatacaactgaagatgataaagatgcagatggtggcgagttgacgtaacaattacggatcatgatgatttcacacttgataacggatacttcgaggggatgacatcagacagcgattcagactccagatagtgactcagncagcgactcagacttcagacagcg

SEQ ID NO: 4254 - DNA, 330 bp; double-stranded, linear
agatgacattaaatagcatctcctcgtgttgattattttggttggctgaccaatatttattctagcacgtagagatgcattttttgtgacaatggtagaaccttttctgaaccatacgcataggattgtnctnttttacaattaaagagccaaccgttgttatagtctaacaatggttgccctcttattttatgtggctaaaaatttataggcaattttattacaacaatgtacatttaaggtgaccttcatgccaaaatcgcatcactcatttaatggaagcagcacgtcttcatataaagtaccgatccctaattccaacgcatgtng

SEQ ID NO: 4255 - DNA, 344 bp; double-stranded, linear
attagtgattgtaaaaaagtaaaactattcttgggagtcggacataaatcaatgtctagactctatagtgttgtatttggcagtagttgacggggccccaacataaagaaatactttttctttagaaattagtatttcttatacatgagttttactcaggatatcctatttttaaatacacattagctgtgtttaatgataaagaaccactacatcataaatctttaatggttctttatcaattccttcccccctctcatgttttgtatctttaaatcaatataattcaaaaaagggtcgaagatatganatcacatcttcgacccttnnttgtactaatttaa

SEQ ID NO: 4256 - DNA, 323 bp; double-stranded, linear
ccagtaatatctaaatgagttggatatttaactttcgcattaatttcaatattaaattgcgttaccgcgacaagncatnacacaacatacataataagattggctaaaaagatatagttaaagctaaattctgcgacaaagccgcccattgcagcaccgacagccacaccaatattttgcgctaagtatatcgcattaaacgtttgtcttccgccatttggccacactgctccagccatagcgtatatcgcaggaataatcattccgccaccaaaccctaacattacaagccatacagcataccaaggccacccgtgganaga

SEQ ID NO: 4257 - DNA, 369 bp; double-stranded, linear
gctgactttccaccagcctctgtgttggggccccgactatttttgaaaagagcgtgttacacggtcattgttttacagtcaactactgctaaaataaaattaacgagcttagggctttgttttctgtcccaagctcgttaaatcacatatgataattaattatgcccaaccacgatatctagctgcttctgctgtacgtttaatacctatggatatatgctgcantctgcatatctatttttcggttttgagacaattcgtaaatcgtatcaaatgccgcttctaatttttncacgtggcttttgcattgaacttcttctngcaggaccaataataaccttggattattttgtgacccatgcggagtga

SEQ ID NO: 4258 - DNA, 335 bp; double-stranded, linear
cctttttcaaaatcattggatgcatcgataaatagtacgttgtcgtcttgttggcgacattttttaaatactaaaatacatgttggaatacttgtcccatagaaaatattggctggtaacccaatcacggcttctaagtagttcttttcttctattaaatagcgacgaatcacaccttctgcggcaccacgaataatacaccatgnggagtacgacgccangtaccttcatcgtctagtaatgtaccagtgttgaataaagcaaagtctgctttgattttggcgcaacttgccgtaaccactgaatcgttcatcatttcaaatttgaactgctgt

SEQ ID NO: 4259 - DNA, 324 bp; double-stranded, linear
atttcgctaccttacgaccgttatagttacggccgccgtttactggggcttcgattcgtagcttcgcagcnacaaccactcctcttaaccttccagcaccgggcaggcgtcaccctatacatcaccttacggtttagcagagacctgtgtttttgataaacagtcgcttgggcctattcactgcggntcttctgggcgttaaccctaaagagcaccccttctcccgaagttacggggtcattttgccgagttccttaacgagagttcgctcgctcaccttaganttctcatcttgactacctgtgtcggtttgcggtacgggca

SEQ ID NO: 4260 - DNA, 400 bp; double-stranded, linear
aagcggttgttagacaatgcattaagaaaaattaaagcggagtttacttttgtaaatgagcatttgattttttgaaaataaagcagtatcgggcgcttgactaaaaagaaattgtacattgaaaactagataagtaagtaaaatatagattttaccaagcaaaaccgagtgaataaagagttttaaataagcttgaattcataagaaataatcgctagtgttcgaaagacacgagcaagattaataacgcgtttaaatctttttataaaagaaaacgtttagcagacaatgagttaanttattttaaagcagagtttacttatgtnaatggagcattgaaaatnatgaaaacgagcccgtatgtggagcgtttggacttataaaaatggtgggaaacata

SEQ ID NO: 4261 - DNA, 334 bp; double-stranded, linear
aattaatgtgcgagttggggtgggacgacgataaagaaatactttttctatagaaattagtatttcttatgcatgagttttactcagtaattcctatttttaagnacacattagctgtggctaantagagganaccactacataataaatcattagtggctctttatcatttctgtcccactcccctgagaagtttaaaattttatatgttggcttgttatgttaagggaattaacatggttgtcttgtttatattatgtgattcaaacattactagtcttggtaaatctaattcgtaaaatgctaaatctaaccatctattaaatttaaaacc

SEQ ID NO: 4262 - DNA, 330 bp; double-stranded, linear
tttcggtcatattcaaacgttttcacttcgccaagccatttttctttgtgtttactttttattttgacgttttaggcataaaaaaaagagaccttggcggtctcaatgcggctcatcgcatccattttttgcctggcaacgttctactctagcggnagtaattgggctaccatcgtcgctaaagacctttcttgacttgtgacaatcgcttgcntctttcctctccttcggctctcgcttactcattnagctctactaaactcgttgcgctcttttctcgtttcgtcagattcaaacgttttcacttcgccaagccatttttctttgtgt

SEQ ID NO: 4263 - DNA, 339 bp; double-stranded, linear
gaggtataccccgggacggctgaaggggatcgaaccctacgnaatgtcggaaccacaatccgatgtgttaccacttcaccacagccgccatggcaggggcagtaggaatcgaacccacaccaaaggttttggagacctctattctaccgttgaactatgcccctattaaaaataataaatggaggggggcagattcgaactgccgaacccgaagagtcggatttacagtccgccgcgtttagccacttcgctacccctccataaatggtgccggccagaggacttgaacccccaacctactgattacaagtcagttgctctaccaattgagctaggccg

SEQ ID NO: 4264 - DNA, 351 bp; double-stranded, linear
gtatttcaaagtaaaattacatgttaatacgtgnttaatgggcgagactcctgagggagcagtgccagtcgaagccgaggctgagacggcaccctaggaaagcgagcattcaatacgagatntnatgaaatagagaacagcagtaagatattttctaattgaaaattatcttactgctgttttttagggatttatgtcccagcctcttactctaattatattcactatcaattagacaaaatggccattttcaaatatcacgcgttgtttctgaccttgaatatatttattataattctctttttggaaaatcagttaacattaatttagatgtaccgtatttttaacact

SEQ ID NO: 4265 - DNA, 346 bp; double-stranded, linear
attttcactttaaaacctgcttctttggctttttgcatataatgttgcgattgttctattgtaaatacacctgtttcacagaaaatatccgcaaagtctgcatattgttttacttccggaagtaacgcaatcatttcttctaaaaatgcctcatttgaacttgcctctttaggtacagcatgaggccctaggaaagtatgtttcatgtctaaatcatatttctcagctaaacgnttagacactttcaattgcttcagttcattttctctatctaatccataaaccactcttgactttcaactgcagtcacgccgtgtttnaatccatagtaagacaaancatgact

SEQ ID NO: 4266 - DNA, 347 bp; double-stranded, linear
tcaaacgctctatccaattgagctacgggcgcatatgtttttattgaaaatggtgccgaggaccggaatcgaaccggtacgtgatcactcaccgcaggattttaagtcctgtgcgtctgccagttccgccaccccggcactataaaaatggagcagaagacgggattcgaacccgcgaccccaaccttggcaaggttgtattctaccgctgaactacttctgcatatgcgggtgaagggagtcgaacccccacgccgtaaggntgagatcctaagtctagtgcgtctgccaattccgccacacccgccaatggtgagncatagaggnttcgaacctctgaccctctg

SEQ ID NO: 4267 - DNA, 337 bp; double-stranded, linear
gacttgttctcttggacctatatcatgttctttattttctaatgcaggatctttaattgcatctttaagtgattcatccgctgcaggatagtttttcgcagtgtttgctggttgcgtgaggtntgtgtttgatttgtatccttaggtggctgagttgtagttgcattattattttgattttccgagattttatctgaagtatttgtattttctgctgcttgtgcttgatgttgagaagtaattaaaaatagtgtactgacaatgaccgatgcaacgcctagagttgattttctaatagaataggaaagaccntnaattttgggtggatgtttgttca

SEQ ID NO: 4268 - DNA, 400 bp; double-stranded, linear
atacatgttggaatacttgtcccataganaatattggctggtaacccaatcacggcttctaagtagttcttttcttctattaaatagcgacgaatcacaccttctgcggcaccacggaataatacaccatgtgggagtacgactgccatggtaccttcatcgtctaggtaatgtaccatgtgttgaataaagggcaaagtctgctttgggattttggcgcaacttggccgttaaccactggaatcgttcatcatttttcanattttggaatctggctggttccattttcggcactggtatggtgggggtttcggcaataaacggcattcaaatggtatttggcctaaacaaggccgggatttttccaatgggggtcatcattaangggatcntcgaagtt

SEQ ID NO: 4269 - DNA, 345 bp; double-stranded, linear
ggctcatcgcatcctggggctgtagtcggtcccaagggttgggctgttcgcccattaaagcggtacggagctgggttcagaacgtcgtgagacagttcggtccctatccgtcgtgggcgtaggaaatttgagaggagctgtccttagtacgagaggaccgggatggacatacctctggtgtaccagttgtcgtgccaacggcatagctgggtagctatgtgtggacgngataagtgctganagcatctaagcatgangccccctcaagatgagattcccaacttcggttataagatccctcaaagatgatgaggatataggtcgaggttggagcatggtacatgt

SEQ ID NO: 4270 - DNA, 370 bp; double-stranded, linear
aagaattaattatacattttattaacatttaagtcaataactttttttatcttgtccattttattttttaaccaaaatttgattaaaaaactgcctggcaacgttctactctagcggaantaagtcgactaccatcgacgctaaggagcttaacttctgtgttcggcatgggaacaggtgtgacctccttgctatagtcaccagacatatgaatgtaatttatacattcaaaactagatagtaagtaaaagtggattttgcttcgcaaacatttattttgattaagtcttcgatcgattagtattcgtcagctccacatggtcaccagcttccacctcgaacctattggncgcatcatctcgcaggganc

SEQ ID NO: 4271 - DNA, 327 bp; double-stranded, linear
tgaggtacgtccagaatngggattggctaaaaatgcatcatttataattggacgacgccaattaacaaaaggcattgatttagaagggcggacatttttacacaattatgattggcgtaaagataaagatggcacattattaaataccatcatttctggtccggcacttgtggcacaatggattaatttacaatattatgcgtcgacagttgcgccgcatttttacggtaatgggaataaagcgacacaaaccgtcacgtcagtgttggtgtcatgcaaggtaatgcgagtgcatctgatgtagggcttatcatggccaatctgtta

SEQ ID NO: 4272 - DNA, 325 bp; double-stranded, linear
cattctttaaactctgtaagtacttcttcaatctcaggggcatctactaacatatcatcagtaatatgcgtcaaattgataatcgtttccgataatcgttcatgcggattactaaacctttcaaacttatcgatgatttcaccgttatgaactttcacagctgcaantcgatgattttatcatactgatttgataaaccagttgtctcaacgtcgaacacaacataagtagcatcttttaatacgacatcttgtgggttgtatgcaatcgggaacaccatcatcaactaacataccttccataccggnatatcattttaangcca

SEQ ID NO: 4273 - DNA, 357 bp; double-stranded, linear
tccggccttgacctgaagaacacttgtcttgtcgttaagatgactctagactcttatgtttattatcaaccgttaataaacttaccatcaagagtgcacctacccatactgacagtgcagtatagaatggtgtcatacctgaaccataatccttaactgggaaaacatcaacagtcttcttattaataggatttgcaataatacccgcttgctttttcaaatcattcttaagtgtgtcgatnaatttgtcgactgcatcatctntgtctaatttcttgaaaattttgattcgcttttttccaaatccttntccaacatcaggcaattttattttgagaaaaatcagccaaatccgga

SEQ ID NO: 4274 - DNA, 400 bp; double-stranded, linear
acgttagcacaagccatgaaccaattaggtggaaagagtaatagtggtgaaggtggcgaagatgcaaaacgttatgaagtacaagttgatggaagcaacaaagtaagtgcgattaaacaagttgcttctgggcgttttggtgtaactagtgattatttacaacatgccaaagaaattcaaattaaagttgcgcaaggtgcaaagcctggtgaaggtggtcaattacctggtactaaggtatatccgtggattgcgangacaagagggtcaacgccaggtatcggtctgatttcaccaccgccacatcatgatatttnattccatangaggatttagccgccacctgatacctggattttggaaaaatggcgaattaaggttgcngattttccccgggtaa

SEQ ID NO: 4275 - DNA, 341 bp; double-stranded, linear
aacgtcgttaattgaataacgcttatgttataagagcactcataccaaaccataatcatctatagatataacaattcacgatataagggctgtgtttggcatagcctttagatatacacttaattcctattaaaatagtagggattaaaagggggcttgtcatggattaaaattcaacaattacaacatcactttggatcacataaagtaattcataactttaatttggacattagcaagggagaaatagtcactttcataggggaaaagtggttgcggaaagtctactttactcaatattatcggtggatttnttccatccatcgnctggtcgtgtccan

SEQ ID NO: 4276 - DNA, 368 bp; double-stranded, linear
tagtgatatacgacatcacagcataatattgctttagaaagtcgtgccgaactggaacttacaagtctagttcgaacacacactgatgtgagtggttttctttattttaaacatgaacaatcagataagttactagcattagcaaatattattaaatcaaagggcttcgattcataaaatttaaaacaatgattaaaattagacgtgtaaattgttaaattctaaaacggaaataaccaccattccattaaaccacttttttgttcatcactatatttcacacngcttcattaataaacggaatgcttcanccgcttcaacttcaactggcttcaacttcngcctacttcatcataccaaacggtccg

SEQ ID NO: 4277 - DNA, 318 bp; double-stranded, linear
atggaagtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttagatacacatgctatcactgatcaaattgactatttaacagctgacgaagaagatagctatgttgtagcacaagcaaactctaaattagatganaatggtcgtttcatgggatgatgaagttgtatgtcgtttccgtggtaacaatacagtnatggctaaagn

SEQ ID NO: 4278 - DNA, 400 bp; double-stranded, linear
cacttgtactttctgatgttgagccagactctgatgtacttaccgatgtagataaacttgcaatggtcgacatgcggtttgaagttgatgtacttagcgaatcacttaatgatgctgatgtgctttgtgaatcggattcgctcgtgcttgtacttgttgagtttgaggcactttggcttgctgagtttgagtctactccgctttgattcattgaggcacttagtgacaatgatgtactcgttgagtcagacaaacttgtactcgttgacgtacttgtacttcctgatgttgattgagacatacttatgctcattggatgttgaatcggatttactttcacttgaatgatgttgagtcggattcactttcacttgtagaaccacttaatgatgtgggatgt

SEQ ID NO: 4279 - DNA, 324 bp; double-stranded, linear
tttgtacttcgatttaaaagatattagacataaaatctaaaancagcagtaagatgatttatgattaaaaactatcttactgctgttcactttttataatacttctgaatgtcttcacttatacttctagtcacagatttaaataatcaaaagtgcacattattaaaatatcaatttcacactcaatgcggctcatcgcattcatttcttgtctagcaacgttctactctagcggaagtaagttagctaccatcctcgctaagaacctttcttgacttgtgacaatcgcttgcttctttcctctccttcggctctcgcttactc

SEQ ID NO: 4280 - DNA, 326 bp; double-stranded, linear
ctcactagtcgagtgacactgcgccgaaaatgtaccggggctaaacatattaccgaagctgtggattgtcctttggcatgtgnttaggagagcgttctaagggcgttgaagcatgatcgtaaggacatgtggagcgcttagaagtgagaatgccggtgtgagtagcgaaagacgggtgagaatcccgtccaccgattgactaaggtttcctgnggaaggctcgtccgctctgggttagtcgngtcctaagctgaggccgacagtagggcgatgggataacaggttgatattcctgtaccacctataatcgtttaatcgatgggggg

SEQ ID NO: 4281 - DNA, 370 bp; double-stranded, linear
tcgaacatgagcgattatttcttatgaattcaagcttatttaaaactctttattcactcggttttgcttggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacattcaaaactggaatacaatatgtcacgttattccgcatcttctgaagaagatgttccgaatatatccttagaaaggnaggtgatccagccgcaccttccgatacgggctgaccttgttgacgacttgcaccccaagcatttgtgcccancn

SEQ ID NO: 4282 - DNA, 400 bp; double-stranded, linear
gagagatgacacggnactgaattggtttgacaccacgtgatgaatgtgatcgtcggccttcttcacgattgnaatacttttacatcaagaacgataccgccagcgccgtgaggtacacgtaatgaagtatctctaacttcacgtgctttttcaccaaagattgcatgtaacaatctttcttcggcagttaactcagttacacctttaggcgttactttaccaactaaaatatctccatcttttacttctgcaccaatataaacgataccacgatcgtctaagttcttaagtgcactttcagaaacattaggnatatctcttgtgatttcctcagggcctaacttagtatcacgtgcctctgaatccatactccttcaatatgaatagaagtatacacggn

SEQ ID NO: 4283 - DNA, 324 bp; double-stranded, linear
aattctacaggcaatgcgagttggggtgtgggccccaacaaagagaaattggattcccaatttctacagacaatgtaagttggggtgggacgacgaaataaattttgagaaaatatcatttctgtcccactcccgattatctcgtcgcaatatttttttcaaagcgatttaaatcattatcatgtccaatcatgattaaaatatcacctatttctaaattaatatttggatttggtgaaatgatggactctttgcctcgtttaattgccataatgttaatnccatattgtgctcttatatctnaatccatgatagactgncccg

SEQ ID NO: 4284 - DNA, 400 bp; double-stranded, linear
aaatcgtaacgagtgaactttcttatttaggtggcgaagtaacttactagcacctgacgaaacggttttagatcgtattcaattgaaaaggccggtattgaatgaatcacacttagcagcgattgatcaggaacattttaaattaacttatttatcaacggtatatgaaggggatttggcaagatgcgttataagcattaggccgtagaagcagtgaaatgctgtnaaacaagggcgctcaaattctagtgttagatgatagtggattagttggatagcaatggctttgcaatgccgatgtttactcgcaatgaagtgcatgtgccatgcaattgacttctttaaagccagatttacgtgatgtctaacaagttttntncgctaaaatcngggtggagac

SEQ ID NO: 4285 - DNA, 560 bp; double-stranded, linear
catttttctttgtgtttactttttattttgacgttttagacataaaaaaagagactcacggtctcaacttgcctggcaacgttctactctagcggaacgtaagttggctaccatcgtcgctaaagacctttcttgacttgtgacaatcgcttgcatctttcctcancatcggntntagcttactcatttagctctactaaactcgttgcgctcttttctcgtttcgtcagattcaaacgttttcacttcgccaagccatttttctttgtgtttactttttattttgacgttttaggcataaaaaaaagagaccttgncggtctcaatgcgggctcatcgcatccattttttgcctggcaacgttctactctagcggaagtaattgngctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttacttttt

SEQ ID NO: 4286 - DNA, 337 bp; double-stranded, linear
gtaacactcggnataacctacctataagactgggataacttcgggaaaccgtagctaataccggataatattttgaaccgcatggttaaaagtggaaagacggtcttgctgtcacttatagatggatccgcgctgcattagctagttggtaaggtaacggcttaccaaggcaacgatgcatagccgacctgaganggtgatcggccacactggaactgagacacggtccagactcctacgggaggcagcagtagggaatcttccgcaatgggcgaaactggacggagcaacgccgcgtgatgnatggaaggtcttcggatcgtaaaactctgttatt

SEQ ID NO: 4287 - DNA, 351 bp; double-stranded, linear
caatcgtgctcantgcgcatcgtnactcatctgtatgtgttccagcatatacaattttgccatctttaatgacaactgtaccatttttcacaacatttaattcatctaattccttacccttcaaaggtttatctgttgatctcggtaaaattaattctggctatatgattaattattaaatcatcattacttatcacctgctttatcaatcatggaatatgaatacctttttctttagctgtttgaatagcgatgtcatagccagcatcaacatgtcgggcaacacccatacctgggtcagtcgtcaatacacgttccaatcttctttcagcacgctctgaatccatctgg

SEQ ID NO: 4288 - DNA, 316 bp; double-stranded, linear
ctattcactgcggctcttctgggcgttaaccctaaagagcaccccttctcccgaagttacggggtcattttgccgagttccttaacgagagttcgctcgctcaccttagaattctcatcttgactacctgtgtcggtttgcggtacgggcacctattttctatctagaggcttttctcggcagtgtgaaatcaacgactcgaagacacaatgtcttctccccatcacagctcagccttaacgagtaccggatttgcctaatactcagccttactgcttaggacgtgcaatccaatcgcacggtttngcctatccta

SEQ ID NO: 4289 - DNA, 322 bp; double-stranded, linear
ttntttatgtctaaaacgtcaaaataaaagcaaacacaaagaaagatggcttggcgaagtgaaaacgnttgaatctgacgaaacgagaaatgtaaagtataataaaaagcagtcataagatgatttcaattagaaatcaatttatgactgtttttcttactatgtgttaaattaacaatgaatataacatcttattttcattaatataaatattggaaggatcganatgatttacacgttgtttgagttgtattaaatcatcatgatctttaagttgaataccaataatgacagtacctgtattttgagagattttttaagt

SEQ ID NO: 4290 - DNA, 338 bp; double-stranded, linear
tcatttagctctactaaactcgttgcgctcttttctcgtttcgtcagattcaaacgttttcacttcgccaagccatttttctttgtgtttactttttattttgacgttttaggcataaaaaaaaagaccttgcggtccaatgcggctcatcgcatccattttttgcctggcaacgttctactctagcggaantaattggctaccatcgtcgctaaagacctttcttgacttgtgacaatcgcttgcttctttcctctccttcggctctcgcttactcatttagctcnactaaactcgttgcgctcttntctcgtttcgtcagatttcaaacgttttca

SEQ ID NO: 4291 - DNA, 400 bp; double-stranded, linear
aattggtttacaccaggtgataatgtatcgtcgccttcttcacgattgaatacttttacatcaagaacgataccgccagcgccgtgaggtacacgtaatgaagtatctctaacttcacgtgctttttcaccaaagattgcatgtaacaatctttcttcggcagttaactcagttacacctttaaggcgttactttaccaactaaaatatctccatcttttacttctgcaccaatataaacgataccacgatcgtctaaagttcttgaagtgcactttncagaaacattgagggaatgatctcttgtgatttcttccaggtcctaacttgagtgatcacgtggcttctggattgcagacgcttgcaagatggaatgagaagtganacacgtgcatccttgc

SEQ ID NO: 4292 - DNA, 326 bp; double-stranded, linear
aaacgttttcacttcgccaagccatttttctttgtgtttactttttattttgacgttttaggcataaaaaaaagagaccttgcggtctcaaatgcggctcatcgcatccattttttgcctggcaacgttctactctagcggaacgtaattgggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtnnactttnt

SEQ ID NO: 4293 - DNA, 356 bp; double-stranded, linear
ggggacaattccctgggggttcaagtcctctcgggccggcatcaaaattcttaatttaaataagcgggtgtagtttaatggcaaaacctcagccttccaagctgatgttgtgggttcgattcccatcacccgctccatagataattttaatgaacattgaaaactgaatgacaatatgtcaacgttaattccaaaaacgtaactataagttacaaacattatttagtatttatgagcnaatcaaacatcataatttttatggagagtttgatcctggctcaggatgaacgctggcggcgtgcctaatacatgccagtcgagcgaacggacgagaagcctgcctcncngatgttagc

SEQ ID NO: 4294 - DNA, 314 bp; double-stranded, linear
ttatcacccatgttctgactcccaagttaaattaattggcattcggagtttgtctgaattcggtaacccgagaggncccctcgtccaaacagtgctctacctccaataatcatcacttgaggcagccctaaagctatttcggagagaaccagctatttccaggttcgattggaatttctccgctaccctcagttcatccgctcacttttcaacgtaatcggttcggtcctccattcagtgttacctgaacttcaacctgaccaaggtagatcacctggtttcgggtctacgacaaatactaaacgccctattca

SEQ ID NO: 4295 - DNA, 345 bp; double-stranded, linear
aagtgaaagaactcggcgtgacacctattgcacgattcgttggttttaaggcagtaggcgttgacccgaaaattatgggtattgggcctgcatatgcgattcctgaagtattgtcactcagcaatctatctgttgaagacattgatttgatcgaattgaacgaagcatttgcttctcaaacgattgcatctattaaagaagtaggtctagatatatcacgtacgaatgtgaatggtggcgctattgctttaggtcatccattaggtgctacaggcgccaatgttaacccgcgcgtttacctaatgaaatggggtaaaccgncccgatagnccgtancgcaagggt

SEQ ID NO: 4296 - DNA, 361 bp; double-stranded, linear
taaattgatttctaattgaaatcatcttatgactgctttttattatactttacatttctcgtttcgtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaantaattcgnactaccatcgacgctaaggagcttaacttctgtgttcggcatgggaacaggtgtgacctccttggctatagtcaccagacatatgaatgtnaattgatacattgcaaaactaggatagtgaagtaaaagtgattttgc

SEQ ID NO: 4297 - DNA, 337 bp; double-stranded, linear
aactcgttgcgctcttttctcgtttcgtcagattcaaactgttttcacttcgccaagccatttttctttgtgtttactttttattttgacgttttagacataaaaaaagagacctcacggtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaagccattttnctttgtgtntactnt

SEQ ID NO: 4298 - DNA, 323 bp; double-stranded, linear
gtattcctccattattataggtaaatcgctattaattataaaattaaatggcggtctcgacgggaatcctgcgtgacagncaggcgtgttaccgctacactacgagaccattagtaaaacggaggaagagggattcgaacccccgcgagccgttaagcccctgtcggttttcaagaccgatcccttcagccggacttgggtattcctncaaaattatatggacctngcaggactcgaacctgcgaccgaacgttatgagccttagctctaaccaactgagctaaaggtcctaaatataatttttacaactaataaaatagtgg

SEQ ID NO: 4299 - DNA, 323 bp; double-stranded, linear
ctacatgcgttgaattagggatcggtactttatatgaagacgtgctgcttccattaaatgagtgatgcgattttggcatgaaggtcaccttaaatgtacattgttgtaataaaattgcctataaatttttagcacataaaataagaggngccaaccattgttagactataacaacggttggctctttaattgtaaaaagaaaaccatacgctatgntgttacaangaaaaaggttctaccattgtcacaaaaaatgcatctctacgtgctagaataaatattggtcagccaaccaaaataatcaacacgaggagatgctattt

SEQ ID NO: 4300 - DNA, 385 bp; double-stranded, linear
ctaacataccacctacaagacctgaagcgaaaccaggtttatccgcaatactacgtgcaatgaatccagataaaattggaatgattaacgcgaatcacttttactaccaatgttccaaagctgctctgcaaacgcattgtactctgagctttttggattaaatgaatttgctccaaataaaaatacaattgccattaaaataccaccagatattacaagtggcaacatgttagaaacaccgttncattgaagtgtttgatagaatgctttacctggggcttgaatttttcttggactgtgcatttgagttaccttttctttggaccatcacggggcaacaaaaggtttgacgacttgtgagctgaatggcttngntgaatgaatt

SEQ ID NO: 4301 - DNA, 348 bp; double-stranded, linear
tcctgtaccacctataatcgttttaatcgatggggggacgcataggaataggcgacgtgacgattggattgcacgtctaagcagtaaggctgagtattaggcaaatccggtactcgttaaggctgagctgtgatggggagaagacattgtgtcttcgagtcgttgatttcacactgccgagaaaagcctctagatagaaaataggtgcccgtaccgcaaaccgacacaggtagtcaagatgagaattctaaagtgaacgaacgaactctcgttaagggactcggcaaaatgancccgtaacttcggggaaaagggtnctctttanggttaacgccccaaaaaaccgct

SEQ ID NO: 4302 - DNA, 385 bp; double-stranded, linear
aatggaacgtgcttctgtattggcccaagtagatattcatcgtgcagcaacacataataaaggtgttatgaatggcatacatgctgttgttttagcaacagggaaatgatacgcgtggtgcagaagcaagtgcgcatgcatnacgcgagtcgtgacgggacagtatcgtggtattgctacatggcgttacgatcaagatcgttcaacgattgattggtacaattgcaagtgcctatggacattgggcaatcgttggcggtggtacaaaagtattaccaattgctaaagcttccattaggngctgactaaatgtagagtcagcacaagaattgaggtccatgttagttggctgccgttgggttttgagcggcaaaaactttgncag

SEQ ID NO: 4303 - DNA, 374 bp; double-stranded, linear
agtgcgacgattggtattttacaagaattttatcaacaagatttaattagcttaaacgcagcaatccctgtgttactaggcgataacattggtaccacgattacagctatcttagctagtttagccggctcaatcgctgcaaaacgtgcggcgcttgtacacgtcatctttaacttaatcggggtaattatcttcacaattttcttgccagttgtgattcatttgattagtttgttacaagatttatgggcacttaaaaccagcgatgacgattgcagtatcacatggnatccttcaacataaccaataccttggattccatttaccaatttgtagccnggtttagcatnggattggttaccaagccttgtccc

SEQ ID NO: 4304 - DNA, 314 bp; double-stranded, linear
aaaacaggatacttcgataagttaatgatttctgttgtgaatcgcgcaccacgtttcttaattttaccgactattatattaattggtattttaggtagtacagccggcgatgctgcgacaatttcttgccgccgcttgcagcaatgctttttattaaaattggctatcaccctatcgctggactaacgatggcatatgcttccgctgttggaggatttgcagcaaatatagttgttggtatgcaagatgctttggtctattcatttacagaaccggcaacacgtatcgtttcagattctattaaaacaaacgtt

SEQ ID NO: 4305 - DNA, 344 bp; double-stranded, linear
cgttgcagaatgtgttgaaatcatcagaaatatgcttaggcaagctaatatcattgtcagccattaatttacggttaccaaccaatatatggtgatgatcaatcgttgcttcaataccatggccaggtactgctttaaatgttgttgtctcagttaatattaattgcttttcttttgcataattgacaatggcttctgccaatgggtgttcagaatctttttcagcagtagcaagtagttgtagcgtttgattgtcaccatgataatctgtcacgactgggacgaccatttgtaatggnanccgtccttatctaaaacgatgggtatcaatttgatgngggcgg

SEQ ID NO: 4306 - DNA, 378 bp; double-stranded, linear
agtttccctgaaaattaatcaaggacttaacattgcgagtcaaggtattgatcaagctaatggacagttaaatgatgccaaagcttcgtcacacaagttagaagtagagtcggtgattatcaagatgcaattcgacgcgcgcaagatttaaatcgaagaaaccagcaacagattcctcaaaatagcgcggcgaacaacgaaacatcaaatagtgcacctgcagctggtaatggtgtagcatcaacgccaccaagtgcaccaagtggcgatactgcaccaaataataatgttacgcaaaataccgcaccagatgagtgaataatgcgcctgtatcgactacaccacaaatgacannccggggaanagatggtcaaattt

SEQ ID NO: 4307 - DNA, 318 bp; double-stranded, linear
ggacttgggtattcctccaaaattatatggaccttgcaggactcgaacctgcgaccgaacggttatgagccgttagctctaaccaactgagctaaaggtcctanatataattttacaactaataaatagtggcggtggaggggatcgaacccccgacctcacgggtatgaaccgtacgctctagccagctgagctacaccgccttatatagtttgtaaataatatggtggagactagcgggatcgaaccgctggacctcctgcgtggcaaagcagncgctctcccagctgngctaagcccccataataattacagtat

SEQ ID NO: 4308 - DNA, 400 bp; double-stranded, linear
tgtacgtttaatacctatgatatatgctgcaagtctcatatctatttttcggttttgagacaattcgtaaatcgtatcaaatgccgcttctaatttttcacgtagcttttcattaacttcttcttcagaccaataataaccttgattattttgtacccattcgaagtaagaaaccgttacaccaccagcacttgctaatacgtctggaactaataatataccacgttcagttaaaatacgtgttgcttctggtgttgtaggtccattagcagcttcaacaacgatactagctttaatatcatgtgcattgtcctcngtaattgggttgaatagcgngggactaaatgcacatcnaatcaacaatcctattggatgtcccaanaattgtacgaccaacacc

SEQ ID NO: 4309 - DNA, 326 bp; double-stranded, linear
caaataaaccagagctagttgcaattgctgaaccacatcctaatagaccgaaaaagagaagtagacgtgcggcaccggcagatcctaatgcaactccagcagatccagcggctgcagcgggtaggaaacggtggtgcaccagttgcaattacagcgccatatacgccaacaactgatcctaatgccaataatgcaggacaaaatgcacctaacgaatngttgttcatttgatgacaatggtattagaccaagtaccaaccgttctgtgccacntnaaacgttgttaataacttgccgggcttcacactaatcaatggtggcaaagt

SEQ ID NO: 4310 - DNA, 313 bp; double-stranded, linear
tcaaagcgccaataacatcttctactgaagtttctttagatttagcattcagtgataatgttattgttgctttttcttccattggaatactttgatgaatcgttaatacagatagttctaactttgatataacatctagtacacgtgccaacataccaacaatatcagttacatataaaattaatgtaaattctcgatggtcaagcattttatcggctactggaaatatcgtttctctatatntataanaagcacttctagatagatcaaactgtttaacggcatcataaatggncaatgtcggatcactttt

SEQ ID NO: 4311 - DNA, 400 bp; double-stranded, linear
ggttcgaatccagctagcccagccattagagccattagctcagttggtagagcatctgacttttaatcagagggtcagaggttcgaatcctctatggctcactacttgcactttccatttttgggaagtgcttttttttaggttctccaccaaatgtggtgggtatataatttaaagaactatttttaaaatacaacttttagagcttttattattaggcggccagtccattattggggctggttgtcttcnttttttctcctttgtacaagctgaaaatcatcattatacgtgcttaaagtggtgaattctgaaccaaagaatcacttgataatttatctatataatcctcnatagaccatataatgctggaataatggatctacancctgagttccan

SEQ ID NO: 4312 - DNA, 318 bp; double-stranded, linear
cgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttaaatgctcatttacataagtaaactctgctttaaaataattaactcattgtctgcnaaacgttttcntttataaaaagattaaacgcgttattaanctgtggagtg

SEQ ID NO: 4313 - DNA, 316 bp; double-stranded, linear
acggtgatcactcaccgcagattttaagtcctgtgcgtctgccagttccgccaccccggcactataaaaatggagcagaagacgggattcgaacccgcgaccccaaccttggcaaggttgtattctaccgctgaactacttctgcatatgcgggtgaanggagtcgaacccccacgccgtaaggcatagatcctaagtctagtgcgtctgccaattccgccacacccgcaaatggtgagccatagaggattcgaacctctgaccctctgattaaaagtcagatgctctaccaactgagcnaatggntcttccatgg

SEQ ID NO: 4314 - DNA, 356 bp; double-stranded, linear
aggaaaagtcgttgtgatacatcaaccagctgaagaagtaccaccaggtggtgctaaaacaatgattgaaaatggtgtattagacggtgttgatcatgtattaggtgtacacgtcatgagcacaatgaaaacaggtaaaagtgtattaccagacctggttatgttcaaacaggacgcgcatncttcaaattgaaagtcaaggtaaagtggtcatggttcatcaccacatatggccaatgatgccattgttgcaggtagctacttcgtcacagcgttacaaacagtgtatctagacgactaggccatttgaaccggtggtttcacatcggtcatttnccgtaaaagnccattccatg

SEQ ID NO: 4315 - DNA, 380 bp; double-stranded, linear
tatcagcatttgtaactgttattgtttataacttctgtgtgaagcgcaatattacaattaaaatgccgaaagaagtaccgccgaatatttcacaagtatttaaggacttaattccattttcagcggtaatcatcattctttatgcattagatttagtcatcgcaacagctttaaatcaaatgtagcggaaggnattttaaaattattcgaaccattatttacagcagcagatgggatggattggtgtcacaattatccttggnggcctttgcatattcngggttgtagggaatcaggtccgtcaatgtagagccagcaattgcagccattacatatgcgatatcggagcggacttcaagttgcctcagcggaggacacgc

SEQ ID NO: 4316 - DNA, 400 bp; double-stranded, linear
gctctaggatgactgattgaatgtccatgaatgaacaacccctttgtttaatatcgagtttggcaaatttacgtttatcagcgtttctatgatcagtacttctacgggtagcgtttctatgtaatttacatcatcttaacatataaatacttcgctatttaattgaaaacatatcctattattctttgtccgttctgacgtttaatatctagccttaggcatttcacttgttaatgaatttaactttcttccactaaccgtccctaaacccaatcccgcaacagtttttaactttttcgttgttgtcctgacatctcattaagaaagtttattctgcttaaaacttataatccacaccctgagcaaacgntncttatgacagagtattaaaataagccgn

SEQ ID NO: 4317 - DNA, 400 bp; double-stranded, linear
ccttattgataatggtatgagaatatttgttcgagatggatgaaggtaatgagtgagaaactggatttttaaagtatgagacaatattttaaaaagttcaattattaacttataagcaaataattgctataaaaaagtttggacgtgtacaattgcaatatgaagattttaaattaattgtaaagtatcgtggagtgggtaacgtgtcagaacatgtatataatcttgtgaaaaagcatcattctgttagaaaatttaagaataaacctttaagtgaagacgttgttaggaaattggtaggagctgggcaaagcgcttcgacgtcaagtttcctgccagcatactccattattggttcggcggtgggaggttaanggaatttacggggaggttctgggca

SEQ ID NO: 4318 - DNA, 319 bp; double-stranded, linear
taactacgtctcctgtttctggattcttaattcctggtttacctggaacttcctctttctctcctgttggtaacttcggatcaaattcgtctcgatgacctggtgttatcgtttctggtccgtattctgttaattcattaatcggatctnttgtgatttcttctttcgattcacctgtactaataatttctccagttaatggattttttagtgttggcgtcgttattgtcttctcacctntttgtccttctcttgtaactttttctgtcccggtgctaaatncggattaaattacggtctttcttgaaggaatctcttc

SEQ ID NO: 4319 - DNA, 368 bp; double-stranded, linear
aggtgcattgagagaatttgtaaatgacgtattaggacctcaagacgatattactaaatttgaatacttaaaaaaatcttctcaaaatacaggtactgtcaattattggtattcaacttaaagatcatgatgatttaatacaactcaaacaacgtgtnaaatcatttcgatccttccaatatttatattaatgaaaataagatgttatattcattgttaatttaacacatagtaagaaaaacagtcataaattgatttctaattgaaatcatcttatgactgctttttattatactttacatttgctcgtttcgtcagattgcaaacgttttcacttcgccaagcccatctttcnttggngtttgcct

SEQ ID NO: 4320 - DNA, 347 bp; double-stranded, linear
taagttagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaantaaagttggnctaccatcgtcgctaaagacctttcttgacttgtgacaatcgcttgcttcttttcctctcctncggctctcggttaactca

SEQ ID NO: 4321 - DNA, 334 bp; double-stranded, linear
gggcaagttacagtggtgcatggttgtcgtcactcgtgtcgtgagatgttgggttaagtcccncaacgagcggcaacccttaagcttagttgccatcattaagttgggcactctaagttgactgccggtgacaaaccgtaggaaggtggggatgacgtcaaatcatcatgccccttatgatttggctacacacgtgctacaatggacaatacaaagggcagcgaaaccgcgagtcaagcaaatcccataaagttgttctcagttcggattgtagtctgcaactcgactacatgaagctggaatcgctagtaatcgtggtccagcatgctacggt

SEQ ID NO: 4322 - DNA, 330 bp; double-stranded, linear
ctgttaaacgactacaggaagtatttacaatcaaactaagcaaaagtattcagatgcctcagataaagcttgggcgcattcaaaatctatttggagaggcacatcaaaatggtttagcaacgatataaaagtgcaaagggttggctaatagatatggctaataaatcgcgctcgaaatgggataatatttctagtacagcatggtcgaatgcaaaatccgtttggaanggagcatcgaaatggtttagtanctcattacaantctttaaagggttggactggggatatgtattcagagcccacgatcgttttgatgcatttcagttcggc

SEQ ID NO: 4323 - DNA, 337 bp; double-stranded, linear
caatgatgccatgagcagtgcctcctttaatagcattttagcactgttttgtcgtatttttaaatataaatttggaatgaataataaagtagtgattaaattaagttgtgtgataggaaacttggacatcaatcaaagtaataggcactacaacgcttattggcggggccccaacaaagaagctgacgaaaagtcacttgcaataatgtgcaagtcngggatgggccccaacatagagaaattgggtccgnaatttctacagacaatgccagttggcggggcccccacatagagaatttcgaaaaggaattctaccagcaatgccagttgggggang

SEQ ID NO: 4324 - DNA, 330 bp; double-stranded, linear
ttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgcccaggcaaaaaatggatgcgatgagccgcattgagaccgcaagntcttttttttatgtctaaaacgtcaaaataaaaagcaaacacaaagaaaaatggcttggcgaagtgaaaacgtttgaatctgccgaacgagaaagagcgnaccgagtttagtagantaaatgagtaagcgaga

SEQ ID NO: 4325 - DNA, 315 bp; double-stranded, linear
ttcatccgctcacttttcaacgtaatcggttcggtcctccattcagtgttacctgaacttcaacctgaccaagggtagatcacctggtttcnggtctacgacaaatactaaacgccctattcagactcgctttcgctacggctccacatttactgcttaaccttgacatcaaatcgtaactcgccggttcattctacaaaaggcacgccatcacccattaacgggctctgactacttgtaagcacacggtttcaggttcgatttcactccccttccggggtggcttttcanctttccctcacggnactggttcac

SEQ ID NO: 4326 - DNA, 309 bp; double-stranded, linear
tattttgacgttttagacataaaaaaagagaccttgcggttanatgcggctcatcgcatccactttttgcctggcaacgttctactctagcggaacgtaagtngaactaccatcgacgctaaggagcttaacttctgtgttcggcatgggaacaggtgtgacctccttgctatagtcaccagacatatgaatgtaaattatacattcaaaactagatagtaagtaaaagtgttttgcttcgcaaaaccatttattttgattaagtcttcgatcgnttagtattcgtcaactccacatgtcaccatgctt

SEQ ID NO: 4327 - DNA, 311 bp; double-stranded, linear
aaagcttataaacgctcatctgacattgtagaattcatgctttcaaaagacgatatactacgacactcctacgaacttgtccaaggattacgaaaagacctaaggttatgtaattngcctaaatttattaatcgtttaaattcagttagtaaaaagtctgtgagtaagggtgtatggaaagtggttaaatattatagaaaacatcaaaggatgttaagaaatacaatttattacccagcatttaataatggtgctatagaaggaattaataataagatnaaattaatcaagtgaatttcttttggttncag

SEQ ID NO: 4328 - DNA, 340 bp; double-stranded, linear
tagcttctgcgagctagcggaatcgaagccccagtaaacggcggccgtaactataacggtcctaaggtagcgaaattccttgtcgggtaagttccgacccgcacgaaaggcgtaacgatttgggcactgtctcaacgagagactcggtgaaatcatagtacctgtgaagatgcaggttacccgcgacaggacggaaagaccccgtggagctttactgtagcctgatattgaaattcggcacagcttgtacaggatagtaggagctttgaaacgtgagcgctacttacgtggaggcgctggtgggatactaccctagctgttttggtntctnacccgacca

SEQ ID NO: 4329 - DNA, 325 bp; double-stranded, linear
aatccatagcgaaatgtataccatcacccatgcgtccttctaaaggtaaatctctacctttttgtgcaccagtacataatataatggcatcatactcagattctaacgttgctttatcaatatcaacaccgacttcaacaccattaatgaaagtaatgcccgattcttccattaacttaatacgacgtcgaaccacatctttatcaagtttcatattcggaataccatacattaataaaccgcctgattctctagcacgttcataaatagttacttgntatcctngtagattaagttcttcagcagcagtaatcctgntggaccg

SEQ ID NO: 4330 - DNA, 327 bp; double-stranded, linear
cacttcaccacagccgccatggcaggngcagtaggaatcgaacccacaccaaaggttttggagacctctattctaccgttgaactatgcccctattaaaaataataaatggaggggggcagattcgaactgccgaacccgaagagcggatttacagtccgccgcgtttaaccacttcgctacccctccataaatggtgcgggcgngnaggacttgaaacccccaacctactgattacaagtcagttgctctgaccaattgagctaaggccggctaagaaatggttccaggacagagtcgaaactgccgacacatgggagctttcaat

SEQ ID NO: 4331 - DNA, 400 bp; double-stranded, linear
gcatcattttcagcttcccacttccacatttggaaaatttctccagtaacaatgaaagaccatatactttttcctacaagagcaggacccggtaacaatacaggttggtaatgcccaataataatgaccatttcccaaatgcctaagaaaataataaatgtgataataggtaatataaatttgttatttgtgggacgtgtcatgaacgcgatgcctccttatacaatgacggttcaacaaagtcatcatatgcaggtggattaaacaaatgatgttgttttaccaatgtcgtaatttcttggatagccggatggnttaaattgttaaaatcaccatagggtgtcccngccgtggactgtggttaaaaacgtcacggactttgtttaaaanggtgcgtcat

SEQ ID NO: 4332 - DNA, 366 bp; double-stranded, linear
ctggtatgcagatttaccacctgcctctccacaantnnggggagagcaaacagatgtgcctgaatcaagtgactggtataacgcatcatacattattatgtggggctctaatgtacctttaacacgtactccggatgcacattttatgactgaagtccgctataaaggtacaaaagtcatttcagtagcaccagattacgcagaaaatgtgaaatttgcagataactggctagcaccgaatcctggttcagatgctgcaattgcacaagcaatgacggcatgttattttacaaggaacattatgttaaatccaacctgaatgaacggtttttattaaattacggttaaaaccattattaccaggat

SEQ ID NO: 4333 - DNA, 400 bp; double-stranded, linear
tattatttcattgagcagaaagaaaattatggcaccaaactttaatatttttttcaatgtcattcttttgangggagtgggacagaaatgatattttcgcaaaatttatttcgtcgtcccaccccaacttgcattgtctgtagaaattgggaatccaatttctctttgttggggcccatccccaacttggcacattattgtgaagctgacttttcgtcacttgctgtgttggggccctcaccccaactcgcattgcctgtagaatttcttttcgaaattctctgtgttggggcccctggactgagaattggaaaaaagcttgttgacaagcgcnattttcgttccatgcaactgactgccaagagaacntcgtgagagcnatgaagaagattggatttga

SEQ ID NO: 4334 - DNA, 309 bp; double-stranded, linear
cgcccttaataacttaatctatgtttccatcctacaggaaacgcgttattaatcttgtgagtgttctttcgaacntatgcgattatttcttatgaattcaagcttatttaaaactctttattcactcggttttgcttggtaaaatctatatnttacttacttatctagttttcaatgtacaatttctttttagtcaagcgctcgcataagcaatatcactttaaccaaaaaatatttgaatgttaaataaacattcaaaactgaatacaatatgtcacattattccgccatcttctgnaagaagatgtt

SEQ ID NO: 4335 - DNA, 329 bp; double-stranded, linear
naggacttttctcggtcagtgtgaaaatcaacgcactcgtanacacaatgtcttctccccatcacagctcagccttaacgagtaccggtatttgcctaatactcagccttactgcttagacgtgcaatccaatcgcacgcttcgcctatcctactgcgtccccccatcgattaaaacgattataggtggtacaggaatatcaacctgttatccatcgcctacgcctgtcggnctcagcttaggacccgactaacccagagcggacgagccttcctctggaaaccttagtcaatcggtggacgggattctcacccgtctttcgctactca

SEQ ID NO: 4336 - DNA, 310 bp; double-stranded, linear
caaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccgnnngaaggtggggatgacgtcaaatcatcatgccccttatgcatttgggctacacacgtgctacaatgggacaatacaaagggcagcgaaaccgtgagtgcaagcaaatcccattaaagttgttctcagttcggattgtagtctgcaactcggactacatgaagctggaatcg

SEQ ID NO: 4337 - DNA, 324 bp; double-stranded, linear
ccagcaccggggcaggcgtcaccctcatacatcaccttacggtttagcagagacctgtgtttttgataaacagtcgcttgggcctattcactgcggctcttctgggcgttaaccctaaagagcaccccttctcccgaagttacggggtcattttgccgagttccttaacgagagttcgctcgctcaccttagaattctcatcttgactacctgtgtcggtttgcggtacgggcactattttctatctaganggctttctcggcagtgtgaaatcaacgactcgaagacacantggctnctcccatcagagctcagccttaacga

SEQ ID NO: 4338 - DNA, 399 bp; double-stranded, linear
cggacatcaaacggatgctgctcgattggcaaatgcatataactagtaacatgatcatcgacatcaaatttagatgatcaaatgtccccaatcattaatttgattcggttgtttgctcaattgattatatgtttttcctagcacttcatgcggcaccatatctttacctagtagccacaaagataagtctaacaagtggcaaccataatcgattaaactaccgccaccttgcaacgctttattggtaaaaacaccccagccaggcactttacgcctacgcatcgcttgtacacgtgctactaaaggtttaccaaccacacctgattcaattgcttttttagcagtaattgccacatctgtgtgacgataatgatatgcgccagtaatantttgtgnttt

SEQ ID NO: 4339 - DNA, 323 bp; double-stranded, linear
tgaggcgattatttcttatgaattcaagcttatttaaaactctttattcactcggttttgcttggtaaaatctatattttacttacttatctagttttcaatgtacaaataatggtgggcctaagtggactcgaaccaccgacctcacgcntatcaggcgtgcgctctaaccagctgagctataggcccatttntttgaatgttaaataaacattcaaaactggaatacaatatgtgcacgttattccgcatcttctgaagaagatgttnccgaatatatccttagaaaggaggtgatccagccgcaccttccggatacggct

SEQ ID NO: 4340 - DNA, 344 bp; double-stranded, linear
ggctagccctaaagctatttcggagagaaccagctatttccaggttcgattggaatttctccgctaccctcagttcatccgctcacttttcaacgtaagtcggttcggtcctccattcagtgttacctgaacttcaacctgaccaagggtagatcacctggtttcgggtctacgaccaaatactaaacgccctattcagactcgctttcgctacggctccacatttactgcttaaccttgcatcaaatcgtaactcgccggttcattcttacaaaaggcacgccatcacccattaacgggctctgaactaacttggtaaagcnccggtttncnggtccaatttt

SEQ ID NO: 4341 - DNA, 351 bp; double-stranded, linear
tgtaccacctataatcgttttaatcgatggggggacgcatagngataggcgaacgtgcgattggattgcacgtctaagcagtaaggctgagtattaggcaaatccggtactcgttaaggctgagctgtgatggggagaagacattgtgtcttcgagtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgacccccgtaaccttcngggaaaaagggntcccctttaagggttaaccgccccaaaaaaccccc

SEQ ID NO: 4342 - DNA, 327 bp; double-stranded, linear
aataatgactcctacgggactcgaacccgngttaccgccgtgaaagggcgtgtacttaaccgtatgaccaaggagccatggctcaccaggtaggactcgaacctacgaccgatcggttaacagccgatagctctaccactgagctactgtggattaatattatgcctggcaacgttctactctagcggaantaaattcgaactaccatcgacgctaangagcttaacttctgtgttcggcatgggaacaggtgtgacctccttgctatagtcaccagacatatgaatgtaatttatacattcaaaactagatagtaagtaaaagtga

SEQ ID NO: 4343 - DNA, 360 bp; double-stranded, linear
accgcttgggctgacatttttggcttgttaagcagcttgcctacttttttggcaatagcaccatacgttgttagagtcccataaggaacctgtcttaattcattccaaacacactgttgaaaatgactacctgttggctttaaaggtattgtgatttcaggattgtcacctttaaaatacgcgtctaaccactgtgtcgcctctctaaatatcgctaaagacgtattttcttccctagtaccatcaccttgttgattttcaaacaaaacagcggtcagacttaccccatcactcaaaagttccaancgtcctgacaggcgaancagagtgaacgctgagactccagaaaaatccccctnt

SEQ ID NO: 4344 - DNA, 313 bp; double-stranded, linear
attccgacatcttctgaagaagatgttnccgaatatatccttagaaaggaggtgatccagccgcaccttccgatacgnctaccttgttacgacttcaccccaatcatttgtcccaccttcgacggctagctcctaaaaggttactccaccggcttcgggtgttacaaactctcgtggtgtgacgggcggtgtgtacaagacccgggaacgtattcaccgtagcatgctgatctacgattactagcgattccagcttcatgtagtcgagttgcagactacaatccgaactgagaacaactttatgggatttgct

SEQ ID NO: 4345 - DNA, 305 bp; double-stranded, linear
attttatcgtaagattttttcgcaatgagatttggatcgtttttgtccactacaatatctaatagttttactttaagtccagcattcacaaaaagtgctgccagttgagcgcccattgtgcctgcgccaagaacggttactttattaattgtcatagtgattcctccaatttagttgaggataagataaccattaagataattggaataacgttgctattttataaaattaattaagtatctttgacagtcatcttagcctcttatttaaggnaaaagcnttatgcttaanataagtctttttta

SEQ ID NO: 4346 - DNA, 400 bp; double-stranded, linear
gtcagttatggcaagtgcatcaacattttcagacacagcaagtcttacggcatcttctatttttaagcttgaatttaacaaatcataagccgtatgaatatttaaatatgccaccatgattgaatggnccctttctattagttaagtttgtgcgtaaagctgtagcaagttgctcaaattcatccccagctgtccactgaaactcctggacgcattcggatgancaacgccaaccaaaatcttgcgcaatatccattaataaaccaattgccctttagaacgtaatcgacatccggattcantaccttcatcgactgcaaatacccataatttccagccttgatgtcagcaatgtaataaccaactgagatgctcattggctgatacgatgntccataca

SEQ ID NO: 4347 - DNA, 337 bp; double-stranded, linear
tctgggttgagtcgggtcctaagctgaggccgacacgtaggcgatggataacaggttgatattcctgtaccacctataatcgttttaatcgatggggggacgcatagggataggcgangtggcgattggattgcacgtctaagcagtaaggctgagtattaggcaaatccggtactcgttaaggctgagctgtgatggggagaagacattgtgtcttcgagtcgttgatttcacactggccgagaaaagcctctagatagaaatangtgcccgtaccgcaaccgacacaggtagtccaagatgagattcntaaggtggagcgacgaatctccgttaa

SEQ ID NO: 4348 - DNA, 318 bp; double-stranded, linear
gttaagacaccgccctttcacggcgtaacacgggttcgagtcccgtagaggtcaccattttttaggtctcgtagtgtagcgattaacacgcctgcctgtcacgcagagatcgsgggttcgattcccgtcgagaccgtacaaatgcctatccaagaggatagnattttttttgcgtttaatattatattaataaaagatatatggacgaatgataatcatattgatttatctgttcgtccattttctttaaaatgtatgaacctcaagtaacttagtggttggatatgaaagataaacgtngacaataaaatctttatt

SEQ ID NO: 4349 - DNA, 319 bp; double-stranded, linear
ctttaaagcacgtataatgatgattttcagcttgtacaaaggagaaaaaaagaagacaaccaagcccaataatggactggccgcctaataataaaagctctaaaagttgtattttaaaaatagttctttaaattatatacccaccacatttggtgnagnaacctaaaaaaangcacttcccaaaaatggaaagtgcaagtagtgagccatagaggattcgaacctctgaccctctgattaaaagtcagatgctctaccaactgagctaaatggctctaaatggctgggctagctgggattcgaaccaacgagtgacgga

SEQ ID NO: 4350 - DNA, 346 bp; double-stranded, linear
acttcgctacccctccagcttattcatataatttaataatcaaaatggtggagaatgacgggttcgaaccgccgaccctctgcttgtaaggcagatgctctcccagctgagctaattctccaaaataatgactcctacgggactcgaacccgtgttaccgccgtgaaagggcggtgtcttaaccgcttgaccaaggagccatggctccacaggtaggactcgaacctacgaccgatcggttaacagccgatagctctaccactgnagctactgtggattgaatcattatgcctggcaacgttcttactatagcggaangtcaagttccgcatnaccatacgaagct

SEQ ID NO: 4351 - DNA, 305 bp; double-stranded, linear
acgtccttcatcggcttctagtgccaaggcatccaccgtgcgcccttaataacttaatctatgtttccaccatttttataagtnaaacgttaacatgaagttacgttcttttataaaaagatttaaacgcgttattaatcttgtgagtgttctttcgaacactagcgattatttcttatgaattcaagcttatttaaaactctttattcacncggttttgcttggnaaaatctatattttacttacttatctagttttcaatgtacaaataatggtgggagactagcgggatcgaaccgctgacc

SEQ ID NO: 4352 - DNA, 302 bp; double-stranded, linear
gttcatcaattgctaattccagtccgcctaacggatcaatttcatccgcatgtattttcactttaaaacctggcttctttggctttttgcatataatgttgcgattgttctattgtaaatacacctgtttcacagaaaatatccgcaaagtctgcatattgttttacttccggaagtaacgcaatcatttcttctaaaaatgcctcatttgaacttgcctctttaggtacagcatgaggccctaggaaagtatgtttcatgtctaaatcatatttctcagctaaacgattagncactttcaa

SEQ ID NO: 4353 - DNA, 411 bp; double-stranded, linear
tctaccgctgaactacttctgcgggtgaagggagtcgaacccccacgccgtanntgaggatcctaagtctagtgcgtctgccaattccgccacacccgcaaatggtgagccatagaggattcgaacctctgaccctctgattaaaagtcagatgctctaccaactgagctaatggctcttccatggtgccggccagaggacttgaacccccaacctactgattacaagtcagttgctctaccaattgagctaggccggcaatatgtaagaataaatggtggagaatgacgggttcgaaccgccgaccctctgcttgtaaggcagatgctctcccagctgagctaattctccgntttaaaactgctggcnacggtctantctaaggggacgtaaggtcgactaccatcgacg

SEQ ID NO: 4354 - DNA, 367 bp; double-stranded, linear
tgcttagatgctttcagcacttatcccgtccacacatagctacccagctatgccgttggacgacaactggtacaccagaggtatgtccatcccggtcctctcgtactaaggacagctcctctcaaatttcctacgaccacgacggatagggaccgaactgtctcacgacgttctgaacccagctcgcgtaccgctttaatgggcgaacagacaagcccttggggaccgactacagccccaggatgcgatgagccgacatcgaggtgccaaacctncccgtcgatgtgaactcttgggggagataagnctgttatccccggggtaacttttatccgttgagcgatgggcccttaccatgcggaaacca

SEQ ID NO: 4355 - DNA, 313 bp; double-stranded, linear
gtattttaaatcatagtggtttatgcgtctttttcaaattctataaaaaatcggatgacgtgtaatctgccatagattaacacattcatccgatttataataataagatagactaacatttattgagagcgggacggaaatgataaagaacgactaatgattgattatgtagcgattctttatcattagtcacagctaatgtgtacttaaaaatatgaatgcatgagttacactcanattagaggaaatactaatttctaaagaaaaagtatttctttatgttggggnccaccccaacttgncattgtctgtt

SEQ ID NO: 4356 - DNA, 335 bp; double-stranded, linear
gggctgggttcagaacgtcgaggcagttcgytccctatccgtcgtgggcgtaggaaatttgagaggagctgtccttagtacgagaggaccgggatggacatacctctggtgtaccatttgtcgtgccangcataagctgggtagctatgtgtggacgggataagtgctgaagatcctgaagcatgaagcccccctcaagatgagatttcccaacttcggttataagatccctcaaagatgatgaggttaataggttcgaggtgngaagcatggtgacagtggnagctgacgaatactaatcgatcgaggacttaatcaaaataaatgttttgcga

SEQ ID NO: 4357 - DNA, 304 bp; double-stranded, linear
gctctaaaagttgtattttaaaaatagttctttaaattatatacccaccacatttggtgnngaacctaaaaaaaagcacttcccaaaaatggaaagtgcaagtagtgagccatagaggattcgaacctctgaccctctgattaaaagtcagatgctctaccaactgagctaatggctctaatggctgggctagctggattcgaaccaacgagtgacggatnaaagtccgttgccttaccgcttggctatagcccaatatatagatggtggaggggggcagattcgaactgccgaacccgaagag

SEQ ID NO: 4358 - DNA, 302 bp; double-stranded, linear
ataatggtgacgttgatgatgcattaacacaaggtaaagcagcaattgatgctattcaagtagatgctactgttaaacctaaagcgaaccaagctattgaagttaaagcagaagatacgaaagaatctattgatcaaagtgaccagttaactgctgaagaaaaaactgaagcattagcaatgattaaacaaattacagatcaagctaaacaaggtattactgatgcaacaacaactgctgaagttgaaaaagcgaaactcaaggacttgaagcatttgataacattcanntcgactcancag

SEQ ID NO: 4359 - DNA, 350 bp; double-stranded, linear
ggttgggaaatcattgcatgagagtgtgaaagggcataaggggagcttggactgcgagacctacaagtcgagcagggtcgaaagaggacttagtgatccggtggttccgcatggaagggccatcgctcaacggataaaagctaccccggggataacaggcttatctcccccaagagttcacatcgacggggaagtttggcacctcgatgtcggctcatcgcatcctggggctgtagtcggtcccaagggttgggctgttcgcccattaaagcggtacanggctgggttcagaacgtcgtnagaaagttcggtccctatccgtcctggggcgtaggaaatttngagaggag

SEQ ID NO: 4360 - DNA, 329 bp; double-stranded, linear
agctcctaaaaggttactccaccggcttcgggtgttacaaactctcgtggtgtgacgggcggtgtgtacaagacccgggaacgtattcaccgtagcatgctgatctacgattactagcgattccagcttcatgtagtcgagttgcagactcacaatccgaactgagaacaactttatgggatttgcttgcacctcgnggtttcgctgtccctttgtattgtccattgtcagcacgtgtgtagcccaaatcataaggggcatgatgatttggacgttcatccccancttcctccggnttgtacaccggcagttcaacttagagtgcccaa

SEQ ID NO: 4361 - DNA, 424 bp; double-stranded, linear
agacataaaaaaagagacctcacggtctcaacttgcctggcaacgttctactctagcggaacgtaagttggctaccatcgtcgctaaagacctttcttgacttgtgacaatcgcttgcttctntcctctccttcggctctcgcttactcatttagctctactaaactcgttgcgctcttttctcgtttcgtcagattcaaacgttttcactncgncaagccatttttctttgtgtttactttttattttgacgttttaggcataaaaaaawgagaccttgcggtctcaatgcggctcatcgcatccattttttgcctggcaacgttctactctagcggaacgtaagttgggctaacaacgtcgccaaagacctttcttgacttgtgacaatcggcttgcttctttcctctccttcggctctcgc

SEQ ID NO: 4362 - DNA, 316 bp; double-stranded, linear
cacaacaagtatctaagatactggccgaagattgtcacagacggtaggggaagggggtcacgtgtacgacccaacatgtggttccggttcatngttgttacgtgttggtaaagaaacgcaattnantcgttatttcggacaagaacgtaacaatactacatacaacttagcaccatgaatatgttattacatgatgtgcgttatgagaacttcgagatccgtaatgatgacacattggaaaatccagcctttttaggcaatacatttgatgcggttattgcgaaccatacagtgcgaaattggacagcagattcca

SEQ ID NO: 4363 - DNA, 318 bp; double-stranded, linear
gggtactaagatgtttcagttctccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttgaataacttaatctatgtttccatcctacaggaaacgcgttgattaatcttgtggagtgttctttcgaacatagcgattatntcttatggaattcaagcntatttaaaacnctttga

SEQ ID NO: 4364 - DNA, 313 bp; double-stranded, linear
ntgcacttaagaacttagacgatcgtggtatcgtttatattggtgcagaagtaaaagatggagatattttagttggtaaagtaacgcctaaaggtgtactgcagttaactgccgaaganagattgtcacatgcaatctttgggtgaaaaagcacgtgaagttagagnatacttcattacgtgtacctcacggcgctggcgggtatcgttcttgcatgttaaaagtattccaatcgtgcaagaagggcgacgatacattatccacctggtgttaaaccaattttagtacgtggtatatatcgttccaaaaacgt

SEQ ID NO: 4365 - DNA, 310 bp; double-stranded, linear
aaccattcgatgcaatagcgtcattcttggatattaatccctaaattgccgtgatatcccgcgtctatcttggcctgtttcaatcactaaatgcgttttactacttacaccactacgggctagttaatagtccgacatagccctctggtatgcttacagctacatctgtnttaatcactgccttttcttgtggctcaagtacgacagttcagctgagaatatgtcataacctgcatccgncttatgatttcgttcgggcattctagcattttctgataatagccttacttgtaatgtgtnagtcattttc

SEQ ID NO: 4366 - DNA, 400 bp; double-stranded, linear
agtggtacttctgttaattggtgaatttggatactggttatattcagctgcaccgcaagcaacttctattgatggcctaactgcctttttacctcaagcaatgggtatggtaattgttgcagtcatttatggctttatgaatatgaaagcagagaatccattccgtaataaaattacgtggttacaaattatttcaggtttcttctttgcatttggtgctttaacatatcttatttcagcacaacctaatatgaatggtttagcactggatttatccttctcaacatccgtggtgctgctacattaanggtattaattcttaaaccacataaacgtcaaagaatggtaatacaatcacggctagtaccatttagtagccgctccgtaccgnaattataaa

SEQ ID NO: 4367 - DNA, 326 bp; double-stranded, linear
cacctggacgaaacggttttagatcgtattcaattgaaaaggccggtattgaatgaatcacacttagcagcgattgatcaggaacattttaaattaacttatttatcaacggtatatgaaggggatttggaagatgcgttagaagcattatgccgagaagcagtgaatgctgtaaacaaggcgctcaaattctagtgttagatgatagtggattagttgatagcaatggctttgcaatgccgatgttactcgcnataagtcatgtgcatcaattacttattaaagcagattacgnatgnctacaaatttaatcgctaaatctggtg

SEQ ID NO: 4368 - DNA, 307 bp; double-stranded, linear
attatagccgaaatgcccaaaatagattttgacgaatattacgaatggttgctttacttgcataaatggctttaggaataagcatcaagtcgccaccaagaatagtaatatcagctgcttcaatggcaacttctgtacctgtancaatggcgataccgatatcagctttaactaatgcaggtgcatcatttacaccgtcaccanccatcgcaaccttcttaccttgttgctgtagtttcgcaatttgtgcagctttttctnctggtagaatatctgcaataacagtatctatgcctacttgttttgc

SEQ ID NO: 4369 - DNA, 396 bp; double-stranded, linear
ttctttctcttcctccgggtactaagatgtttcagttcaccgggtgtgccttctgatatgctatgtattcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatctatgtttccatcctacaggaaacgcgttattaatcttgtgagtgttctttcgaacaytagcgattatttcttatgaattcaagcttatttaaaactccttattcaatcggttttgcttgggtaaaatcctatattttacntaccntatcgagttttcaatgtaacaa

SEQ ID NO: 4370 - DNA, 315 bp; double-stranded, linear
cagtaagataattttcaattagaaaatatcttactgctgttctctatttatacaatacttcgtattgaatggcttcgctttcctagggtgccgtctcagcctcggtcttcgactggcactgctccctcaggagtctcgccattaatactacgtattaacatgtaattttacttttacatacttttaaaaaataagacactttgccaaacttgcacataaatgtttaattcaataatttgaattttctgtgttgggtcccttcgtataatttaataaataccactaaactaaattartgaagtgccttatgtataa

SEQ ID NO: 4371 - DNA, 322 bp; double-stranded, linear
gtcgtcaaatgtaccttcaccaagtagtgatgtacatatttaccgccttgttcaacagcacgtgtcggcgcacctgtaatcgcaatgacaggtatgcgttcanatatgaacctgcgataccgttgacggcacttaattcgccaacaccaaatgtagtaactaatgcagcgagtccattaagacgggcataaccgtccgctgcgtaacttgcgtttaattcatttgtatttcctacccaatctacaatggggttgctgataatatcgtctagaaaagcgagattaaaatcaccagggncaccaaaatttttatcgacggcntg

SEQ ID NO: 4372 - DNA, 327 bp; double-stranded, linear
cctaagtctagtgcgtctgccaattccgccacacccgcaaatggtgagccatagaggattcgaacctctgaccctctgattaanagtcagatgctctaccaactgagcnaatggctcttccatggtgccggccagaggacttgaacccccaacctactgattacaagtcagtttgctctaccaattgagctaggccggcaatatgtaaagaataaatggtgggagaatgacgggttcgnaacggcggaaccctctgcttgtaaagcagatgctctccagcttgagctaaatctccgatttaaaactgctgggcaagttctactctag

SEQ ID NO: 4373 - DNA, 400 bp; double-stranded, linear
cattttaatttattgtacagaacgaaatgtgatgttagtagatcatagggttgatgataatattaaagctgaaaacgttatatttattggccttttgtgtaaacatggacattggcatgcagtcatttatgacattgctcaagacaaaactgccgaactcgaaattgaaaatattatagatatttcgtattcattcggtaagacgattcaaaccagagacatatccattgataactatcatcaatttttaaaccccatcgattcctaaaaaacagcagtaagatgattttcaattagaaaatatcttgctgctgttctctatttatacaatacttcgtattgaatggctcgctttcccagggngccgctcagcctgggcctcgactggcaatgctccctc

SEQ ID NO: 4374 - DNA, 334 bp; double-stranded, linear
taatggattttttagtgttggtgtcgttattgtcttctcacctttttgtccttctcttgttactttttctgtccctggtgctaaatcaggattaaatttacgttctttctcgaatggaatctcttctttttctacaatcgagtctccttttacaggtccatattttgttacgctatcgaccggtggtctaactacatctcctgtttctggattcttaattcctggtttacctgggaacttcctctttctctcctgttggtaacttcgggatcaaattcgtctcgatggacctggtgttgancgtttctgggtccgnaagtctgtngaattgcag

SEQ ID NO: 4375 - DNA, 305 bp; double-stranded, linear
atacatgcaagtcgagcgaacggacgagaagcttgcttngtgaatgttagcggcggacgggtgagtaacactggataacctacctataagactgggataacttcgggaaaccgnagctaataccggataatattttgaaccgcatggtnaaagcttgcaaagacggtcttgctgtcacttatagatggatccgcgctgcattagctagttggtaaggtaacggcttaccaaggcaacgatgcatagccgacctgagagggtgatcggccacactggaactgagacacggtccagactcctacggg

SEQ ID NO: 4376 - DNA, 305 bp; double-stranded, linear
gataaagtgaaagaactcggacgtgacacctattgcacgattcgttggttttaaggcagtaggcgttgacccgaaaattatgggtattgggcctggcatatgcgattcctgaagtattgtcactcagcaatctatctgttgaagacattgatttgatcgaattgaacgancatttgctctcaaacgattgcatctattaaagaagtaggtctagatatatcacgtacgaatgtgaatgntggcgctattgctttaggtcatccattaggtgctacaggcgcaatgttaaccgcgcgtttacttaa

SEQ ID NO: 4377 - DNA, 324 bp; double-stranded, linear
aatgtcttctaccccatcacagctcagccttgaacgagtaccgggtttgncctaatactcagaccttgactgcttagacgtgacaatccaatacgacacgcttcgcctatcctactgcgtccccccatcgattaaaacgattataggtggtacaggaaatatcaacctgttatccatcgcctacgcctgtcggcctcagcttaggacccgactaacccagagcggacgagccttcctctggaaaccttagtcaatcggtggacgggattctcacccgtctttcgctactcacaccggcattctcacttctaagcgctccacatg

SEQ ID NO: 4378 - DNA, 400 bp; double-stranded, linear
catcatgcttagaaaacgcttaatttaggttttgactttttaatcagagtatataagcaaaacttatcatacaggtaaggtgtaataagtattttttattaattgagaataattatcaatttcgcgaatgattcaattcaatttttaaacgtattatttcattgagcagaaagaaaattatggcaccaaactttaatatttttttcaatgtcattcttttgatgggagtgggacagaaatgatattttcgcaaaatttatttcgtcgtcccaccccaacttgcattgtctgtagaaattggggaatcccaattcctccttggtgggggcccatccccaccttgcacataatggnagcnggacctttccgccgctccggggtgggggcctcnaccccantc

SEQ ID NO: 4379 - DNA, 345 bp; double-stranded, linear
ataaaatatatcacttgaaaaatttcatgtagaaaagatgatggataggctataaagtaattgtgactgagatgaacttttatgtcttagacactacaacactatattggcagtagttgactgcggggccccaacatagagcaaattggattcccaatttctacagacaatgcaagttggggtgggccccaacatgaaagaaatactttttctttagaaattagtatttcttatgcatgagtgtactcatgttgcgattatttttnagtacacattagctgtggactaatgataaaggnntcgctacataatccatccattaggtcgttccttgattcattccct

SEQ ID NO: 4380 - DNA, 363 bp; double-stranded, linear
ctaaagctgncatatgcggcttgccgatgaagccaaccctgctgctgttggtacaaaattgtcgctttcaatttctgcataccaatcgatgccagctctatttctgacaatatccatatattttgaaattttctctaattctttgccactaaccttttcaccattcaaccaaaattgatcctgtgttaactggtcgttaaaagtgactttcgtttcagtgtaaaatttttctaatgtaacagatatgctattattcatggaagattagtgcttcatcttttttaccccaatattttataagtgcaatatcgtagtgcaggcttgccactttaacacgcataactcctaaatctcaaccagatn

SEQ ID NO: 4381 - DNA, 400 bp; double-stranded, linear
acctgaatgactcaaacttgactttncgacaattgactgtncattttgcatagttgtatgnctccattncgtaattattagatttgttcgcttacgtctattgaatcatacagctttattatagttagcgtatttgcacctttgcacattaaaccatgtttaataatcattgaatcattattaagtaaattaaggaatctataatgttcgttaaataaaactgatcccgttgtggcttcacacccgatagatagggatttacagataaattcaggtctcttccacgtccatatttgggacccatcgaaaatcgggttctcaaatcatcgaacataacaaaagaagctaagcaacagtagggccgttgtcacttaacttctgtttttccgatgacagcttc

SEQ ID NO: 4382 - DNA, 304 bp; double-stranded, linear
gnactacaaagcaatggggtttgccagtttctttatttactgacgaatactggcaatgacatcagatacatgtggcancaccaatccatttcttttcaccattgataacccaagtatcgccttgggttgcagggactgtttcaagacctcccgcaacgtccgaaccgtgttctggttcagttaaagcaaagcatgttacgcnttcatgtgaactgtaatttaggtacatatttcgcaatttgttctttgctacctccgaaatagaaagtgttatgccctaaaccttggtgaacaccgagtaggg

SEQ ID NO: 4383 - DNA, 308 bp; double-stranded, linear
gtgcattattttggagaattagctcagctgggagagcatctgccttacaagcagagggtcggcggttcgaacccgtcattctccaccattttgattattaaattatatgaataagctggaggggtagcgaatggctaaacgcggcggactgtaaatccgctccttcgggttcggcagttcgaatctgcccccctccaccatctatatattgggctatanccaagcggtaaggcaacggactttgactccgtcactcgttggttcgaatccanctagcccagccattagagncattaactcagttggta

SEQ ID NO: 4384 - DNA, 309 bp; double-stranded, linear
aattttggccaaaacacccatccgctgtaacttcagagtgtcattggcatttattacactatctccaactcctagtggaacaaccacatctcgtccttggggtgcatggaatgttccgtcagccctgtgaattatttcttgaactccaccacctggggcgtttccagaacctctatcatttaatacagcaaatgtcggttgcgttaatgctcctgaattatcggkagctacaccctttcctgctaaagtaccagtagacaatgtaggtattggcttgatgagatttttatcagtaatggctttaganat

SEQ ID NO: 4385 - DNA, 308 bp; double-stranded, linear
aaaggtgaaaagcaccccggaaggnaggtgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcanaacaggtctgaatagggcgtttagtatttggtcgtagccganaaccaggtgatctacccttggtcaggttgaattcagtaacactgaatggaggaccgaaccgacttacgttgaaaagtgagcggatgaactgaaggtagcggagaa

SEQ ID NO: 4386 - DNA, 400 bp; double-stranded, linear
tagaatcttcatcaatatgatctaaccaatattgataaaaccttgatgtgtttcgtgtcaatgacataccatatcgactaggtacctttttagaatgttgattaatcanggcaaatatcatggcaaggtcatcttcaaaatgattcgattcaagtggaaggcatatgacgtctcatcactataccctttttcccattctgcaaatccaccataaatactacgcgacgcggaacccggacccattcgcggcaatctcggtnaatccttatctggacagctggcatgtctagcggctggatttacaagctggctggctaaagctggcatatgcgcttgccggttgaagcccaacctggctggctggtggggnacaaattggtcgcttttcaatttcnggcat

SEQ ID NO: 4387 - DNA, 310 bp; double-stranded, linear
tcaatttatggggcattatgactttatatacctaaaatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgcgacaaaaggttagtttgaaattcncgngtggggcagaattgataaagaaccacnaatgacgataaagattaaaaggaggacgttatggatgacga

SEQ ID NO: 4388 - DNA, 310 bp; double-stranded, linear
aacatcatgctgatgttgttgaatatgaagaagatacaaacccaggtggtggtcaggttactactgagtctaacctagttgaatttgacgagattctacaaaaggtattgtaactggtgctgttagcgatncatacaacaattgaagatacgaaagaatatacgactgaagtaatctgattgaactagtagatgaactacctgaggaacatggtcaagcgcaaggacccattcgaggaaattactggaaaacatcatcatatttctcatcnggtttaggnactgaaatggtcacggtaattttggcgtgg

SEQ ID NO: 4389 - DNA, 302 bp; double-stranded, linear
tttaccatatcatccactatttattaaacctaataaagatgaattagaagtgatgtttaatacaacagtgaactcagacacagatgttattaaatatggtcgtttgttagttgataaaggtgcgcaatctgttattgtctcgcttggcngtggatggtgctatttatattgataangaaatcagtattaaagcagttaatccacaagggaaagtggttaatacagttggctctggtgatagtacagttgcaggcatggtggctgggaattgcttcaggtttaacgnttgaaaaggcattcca

SEQ ID NO: 4390 - DNA, 333 bp; double-stranded, linear
aaagagtgcgtaatagctcactagtcgagtgacactgcgccgaaaatgtaccggggctaaacatattaccgaagctgtggattgtcctttggacaatggtaggagagcgttctaagggcgttgaagcatgatcgtaaggacatgtggagcgcttagaagtgagaatgccggtgtgagtagcgaaagacgggtgagaatcccgtccaccgattgactaaggtttccagaggaaggctcgtccgctctgggttagtcgggtcctaagtgaggcccacagcgtaggcgtggatacaggttgtatnccttaccacctataatcgnttaatcgtgggg

SEQ ID NO: 4391 - DNA, 306 bp; double-stranded, linear
agtgcgtttgtgcacanacttgactgnaacttagtgccattgcagcaccagcaacccatggcgcaataagcccaatgcagctatagggataccgncaatattatagccgaatgcccaaaatagattttgacgaatattacgaatggttgctttacttgcataaatggctttaggaataagcatcaagtcgccaccaagaatagtaatatcagctgcttcaatggcaacttctgtacctgtaccaatggcgataccgatatcagctttaactaatgcaggtgcatcatttacaccgtcaccaaccat

SEQ ID NO: 4392 - DNA, 355 bp; double-stranded, linear
tacggtatgcatatcttttaaaacctattcttttgttattaggacatataaattcatcattaagttcgtcatatttccaattttaagtgttgaaaatgtcacttttaaactttctagttttatctttaataaacatgccatacgtaataagtggcgttttattaaaatcatctataatagccatatagttttgctcactaccataacctgcatcagctacaatatactccggtaaataaccgaagggattttgaatcattgttaaaaatggaattaaagttctagtatctgttgggttttgaatagggtcatgggataaaccaaatgnggaatttgccncaattngtaaatggaa

SEQ ID NO: 4393 - DNA, 364 bp; double-stranded, linear
cattccgtaataaaattacgtggttacaaattatttcaggtttcttctttgcatttggtgctttaacatatcttatttcagcacaacctaatatgaatggtttagcaactggatttattctttctcaaacatccgttgtgcttgctacattaactggtatttatttcttaaaacaacataaaacgtcaaaagaaatggttattacaatcatcggcttagtactcattttagtagccgcttctgttacagtatttataaaataaggagtgtagatgtcatgaaaaaatcagcggtttaaatggaacctattccaaagccatcgcgaccaatgggtcatttggattantaacgataatggcgnngg

SEQ ID NO: 4394 - DNA, 315 bp; double-stranded, linear
gattaaaacgattataggtggtacaggaatatcaacctgttatccatcgcctacgcctgtcggcctcagcttaggacccgactaacccaggancggacgagccttcctctggaaaccttagtcaatcggtggacgggattctcacccgtctttcgctactcacaccggcattctcacttctaagcgctccacatgtccttacgatcatgcttcaacgcccttagaacgctctcctancattgtgccaaaggacatgccacagcttcggtgaatatgtttagccccggtacattttcggcgcatgtncactcgact

SEQ ID NO: 4395 - DNA, 322 bp; double-stranded, linear
agcccccaaatgggtattgaaattgaatggtgggncctgaantggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtcccaccttcgacggctagctcctaaaaggttactccaccggcttcgggtgttacaaac

SEQ ID NO: 4396 - DNA, 303 bp; double-stranded, linear
tcggctctcgcttactcatttagctctactaaactcgttgcgctcttttctcgtttcgtcagattcaaacgttttcacttcgccaagccatttttctttgtgtttactttttattttgacgttttagacataaaaaaaganacctcacggtccaaacttgcctggcaacgttctactctagcggaantgaattggctaccatcgncgctaaagacctttcttgacttgtgacaatcgcttgcttctttcctctccttcggctctcgcttactcatttagctctactaaactcgttgcgctctt

SEQ ID NO: 4397 - DNA, 377 bp; double-stranded, linear
taagaatataaatgattttgaaagcatttgaaagctacaacatttctataaaatttttcaataacaattgcgccactaaaactcaaaatttccaccaccaacatccaaattatcaacatcgcaacataaccaaatgttataataaatctattacacaaagagataaattacttatgcaaaggcggaggaatcacatgtctattactgaaaaacaacgtcagcaacaagctgaattacataaaaaattatggtcgattgcgaatgatttaagagggacatggatgcgagtgaattccgtaattacattttaggcttgattttcctatcgcntccttatctggaaaaanccgaccaggatntgcagatgcctggccagg

SEQ ID NO: 4398 - DNA, 313 bp; double-stranded, linear
tgcaataacagtatctatgcctacttgttttgcaatggcttgagcagtgtttttattatcgccagttaacatgggcaacttcaatgcccatatcatggcaattgttttatagcatctttgggcatgatntttgacagtatctgccactgcgatgataccagttaatgaataattaacagcaatgagcatancagttttaccatctcgttcataatgtgttaaatcatcagaaatatgcttaagcaactaatatcattgtcaaccattaatttaccgttaccaaccaatatatggtgatgatcnatccttcctc

SEQ ID NO: 4399 - DNA, 400 bp; double-stranded, linear
tggctatgatcatccaaaatatggtgaatcaattgctgcagccattatacttcgcgaagatgaacctcattacgctgaaattttaaatcaacatatgcgaagtcgtttagcaggttataaagtcccaagaatgtatgtaccagtgacacatatgccgttaaacagtacgcagaaaccagataaacttgcgattcgacaaatgatgaatgacaaagtctcgcaaacactttaaaggtgataaaaatttttgacatttagtgtaagcgtttacaaataaagcgtgttgtttttgaattaaatgcatttcacattagtattcatattatntttaggaggaatttatatgacatttgaaaaagaacgggcttaaaacattattcctgagatgtactagtatgct

SEQ ID NO: 4400 - DNA, 409 bp; double-stranded, linear
ctcatttagctctactaaactcgttgcgctcttttctcgtttcgtcagattcaaacgttttcacttcgccaagccatttttctttgtgtttactttttattttgacgttttagacataaaaaaagagacctcgtctcaacttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtttcgtcarattcaaacgttttcacttcggccaaggcatttttctttgtggttactttttaatttggacggttttaggcataaaaaaaaaggggaccctgcgggctcnaaaggggg

SEQ ID NO: 4401 - DNA, 311 bp; double-stranded, linear
tcatgtagactttcaagaatcgacacatgaaaattcaaaacatcatgctgatgttgttgaatatgaagaagatacaaacccaggtggtggtcaggttactactgagtctaacctagttgaatttgacgaagattctacaaaaggtattgtaactggtgctgttagcgatcatacaacaattgaagatacgaaagaatatacgactgacatnnatctgattgaactagtagatgaactacctggaagaacatggtccaagcgcaaggnccaatccgaggaaattgactggaaaacaatccatccatatttcc

SEQ ID NO: 4402 - DNA, 330 bp; double-stranded, linear
ttaacggattatttggcaattcggttagttgtcgaacaattgctagttggtgatgagtttaagtcagtcgctaaagattgtgaaagtagatcggaaaattggtttaagcaaactgttgcatcatggtgttactacagtgatatgcctagcgatgtattactacaacatggacgtcaatgtaaattncaaacgtttattcattttggcagcaactatggaataaaaatgtatttaaaaatttatggctaattgcctggggaaatgacatacgaatctcaggttaaaacagaaaattaaagcaggtccatgtnaagtgtgggcgggncgcat

SEQ ID NO: 4403 - DNA, 340 bp; double-stranded, linear
tgntcacacataatttgcggccatatgttgttggcactggccgttttgattatctggcactttgggcccatatgttgncaaaatacgcgccaattgcttctttataagttgttatttttttactttttccatcgataagccatacctctggatgatacatatgatgccccatcgcagaccaatagcgaaattcacccgttaaagtttcgagctctgataattgtatagaccattgatgattttgaggtggtacttgatataaattttcttctctaaaatattcatttaaaatgcgttcgatagccgcatacgctgccatgttgtattaatcnttaatttg

SEQ ID NO: 4404 - DNA, 307 bp; double-stranded, linear
ttaacatatattttgggaccttagctggtggtctgggctgtttccctnnacgaacacggaccttatcacccatgttctgactcccaagttaaattaattggcattcggagtttgtctgaattcggtaacccgagaggggcccctcgtgccaaacagtgctctacctccaataatcatcacttgaggctagccctgaaagctatttcgggagagaaccagctgatttccaggttcgattggaatttctccgctaccctcagttcatccgctcacttttccaacgtnaatcggttcggtgcctgccatt

SEQ ID NO: 4405 - DNA, 323 bp; double-stranded, linear
tttttttaagtctgatgtgaaagcccacggctcaaccgtgatgggtcattggaaactggaanacttgagtgcagaagaggaaagtggaattccatgtgtagcggtgaaatgcgcagagatatggaggaacaccagtgggcgaaggcgactttctggtctgtaactgacgctgatgtgcgaaacgtgngggatcaaacaggattagataccctggtagtccacgccgtaaacgatgagtgctaagtgttagggggtttccgccccttgagtgctgncagctaaacgcattaagcactccgcctgggggagtgacggaccgcaag

SEQ ID NO: 4406 - DNA, 315 bp; double-stranded, linear
aattatgggatgcaatgggatacgaacgtgttaaaacacgtatggaagacgaacttggagacttaccacaatggattagtgatttagatggtggcttttataaacaagatgagaccattgaatatgcaacacctatttctcacttcgtaaaagatgaactttgggataaaggtgatgccaaactttccgtaactcatgatgatcaactgttactgaaattacaaagtaaaaataatgtcattaccgatgaattcaacggtgcgttagttgatgcgattgatttactgggaaatgacccttacncnagnatgggta

SEQ ID NO: 4407 - DNA, 333 bp; double-stranded, linear
caccacctccctacctactcgccccccatcataaaataggtggacaggaatatcaacctgttatccatcgcctaccctgtcgcctcagcttaggacccgactaacccagagcggacgagccttcctctggaaaccttantcaatcggtggacgggattctcacccgtctttcgctactcacaccggcattctcacttctaagcgctccacatgtccttacgatcatgcttcaacgcccttagaacgctctcctaccattgtccaaaggaatcncacagcttcggtaatatgtttagccccggtacattttcggcgcatgtcactcgactantg

SEQ ID NO: 4408 - DNA, 393 bp; double-stranded, linear
atttaatgaagtgcttgttaatgaaccaagcgctaaagatactgttgaaattttaaaaggtattcgcgaaaaattcgaagaacaccatcaagtaaaattaccagatgacgtattaaaagcatgtgttgacttatcaattcaatatattccacaacgattattaccagataaagcaatcgatgtgttagatattacagcagcacatttatctgcgcaaagtcccagctgtcgataaaggttgaaactgaaaaacggatttctggatttngaaaatgataaacgtaaagcagtaagtgcttgaagggattttaaaaaagctgacggaccattccaaaattggaatccaaatcnnttaccaggttaaatttgggaaaatggttaattggtgggacc

SEQ ID NO: 4409 - DNA, 319 bp; double-stranded, linear
gacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttaggcataaaaaaaagagaccttgcggtctcaatgcggctcatcgcatccattttttgcctggcaacgttctactctagcggaagtnaattgggctaccatcgtcgctaaagacctttcttgacttgtggacaatcgcttggcntctntcctctccttcgg

SEQ ID NO: 4410 - DNA, 325 bp; double-stranded, linear
aattaaacatttcattttaatcaatgagactaanatacgcctaacttcgttaacttttaaaatgtattaaaattctaaagtttcttttgctttttcnatgatgtcatttttgtttggtaaccaaacattttcagcttgagtgaatggataaattgtatctgcctgcctgaactcttccaataggtgcttctaatgaaaggattgcacgtcacttaattcagctaacaactgctgcaccaacaccagcttgcngttgtgcttcttgactacaaactgacgaccagtttttcaactgagcacaattgtgcacatcgattggtgacag

SEQ ID NO: 4411 - DNA, 400 bp; double-stranded, linear
gagttggacaatgccgaagcgtgagcaaagtttttaccatgcatggttgcatttagcgcaacatgaccatagttttactaaagcacagcgccaagtgattaaaggcttacccaatgatcctgaaatgacgatagagtcagtattaactcatttttcaatagatcaggaagactancaagcttatgttgaaggacatcttttggcgttaccgggttnggcangtatgttgtattaccgttcaccacagcatcactttgaaccacctttgttaacgggttaattggccattcgggtaagttgtccgaccattgccaagtgggtgatgagttnaggccagtccgcaaaagattgggaaagtagtccggaaaatgggttaagccaacctgttgccatccagggg

SEQ ID NO: 4412 - DNA, 369 bp; double-stranded, linear
gatatatggcagctcaaaggaatgggtttcagttgaagtgaaattatcacagtcactagacccgagcacattatttcatctcactgacaatgaggcaggagatcgcttttatatgcgtttgaatgataatcgaacgtcatattttggctacaaagcaattcaattattcaaaaataattctaaaaataaacaatctattttaaaagactggggaaaattaaacataaccatcaccatttataccatccgcnattctgggaaccatcatccttcgagttgttggagggttccatttccaagccataaatcagatgatgaatggcgngagtttggcctaaancatttggaatacccggagttttaattcca

SEQ ID NO: 4413 - DNA, 315 bp; double-stranded, linear
taccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggtctcaacttgcctggcaacgttcnactctagcggaagtaagtgggctaccatcgtcgctaaagacctttcttggacttgtggacaancgcttgcgtccttncctc

SEQ ID NO: 4414 - DNA, 309 bp; double-stranded, linear
gaccatctcctaaggctaaatactctctagtgaccgatagtgaaccagtaccgtgaggaaaggtgaaaagcaccccggaaggaggtgaaatagaacctgcaaaccgtgtgcttacaagtagtcagagcccgttaatgggtgatggcgtgccttttgtagaatgaaccggcgagttacgatttgatgcaaggttaagcagtaaatgtggagccgtagcagaacagggtctggaatagggcgtttagtatttggtcgtanccgnaaaccaggtgatctacccttggtccagttgaagttcaggttnacact

SEQ ID NO: 4415 - DNA, 300 bp; double-stranded, linear
tttattatactttacatttctcgtttcgtcagattcaaacgttttcacttcgccaagccatctttctttgtgtttgcttttattttgacgttttagacataaaaaaagagaccttgcggtctcaaatgcggctcatcgcatccactttttgcctggcaacgttctactctagcggaantaagttcggactaccatcgacgctaaggagcttaacttctgtgttcggcatgggaacaggtgtgacctccttggctatagtcaccagnacatatgaatgtgaaatttatacattcaaaactn

SEQ ID NO: 4416 - DNA, 286 bp; double-stranded, linear
agaaaaataagcgaactgnaataaataaagattcaattaacgcatcagtattaggattcactctaaaacgattaatagttttataagaaggtgtttgatcttgagctaaccacatcattcgaatactgtcatgaagtaatttctctattctacgaccagaaaatacagattgagtatatgcatataagatgatttttaacatcatctttggatgataggatgttgcgccacgatgatgtctgaattcatcgaatttgctatcaggtatcgtttcaacaatttcatt

SEQ ID NO: 4417 - DNA, 400 bp; double-stranded, linear
tttgataaaaatgggccatcgtcacgagcttcaacaattcgtttcgcaacgttttcgccaagcccagcctgatatattacatgaggagcggtgcaaatgttgttagaaattaaagatttagtgtataaagcgagcgatagaatcatactagatcatatcagtctaaaagtagataaaggcgagagtattgccattataggtccatcaggtagtggtaaaagtacatttcaaaagcaaatatgtaatttgtttagtccaactagtggagaactttattttaaaggtaaaccctataatgattatgacccggaagaattgcgtcaacgaatccagttatttggatgcagccaaagtggacttgtttggtggaacgnattggangataaccatggataattcc

SEQ ID NO: 4418 - DNA, 286 bp; double-stranded, linear
gtatttacaatcaaactaagcaaaagtattcagatgcctcagataaagcttgggcgcattcaaaatctatttggagaggcacatcaaaatggtttagcaacgcatataaaagtgcaaagggttggctaatagatatggctaataaatcgcgctcgaaatgggataatatttctagtacagcatggtcgaatgcaaaatccgtttggnaaaggancatcgaaatggtttagtaactcatacaaatctttaaaaggttggactggggatatgtattcaagagcccacg

SEQ ID NO: 4419 - DNA, 300 bp; double-stranded, linear
ctcacttctaagcgctccacatgtccttacgatcatgcttcaacgcccttagaacgctctcctaccattgtccaaaggnatgcncacagcttcggtaatatgtttagccccggtacattttcggcgcatgtcactcgactagtgagctattacgcactctttaaatgatggctgcttctaagccaacatcctagttgtctgggcaacgccacatccttntccacttaacatatattttgggaccttagctgggtggtctgggctgtttccctttcgaacacggaccttgatcaccccatg

SEQ ID NO: 4420 - DNA, 336 bp; double-stranded, linear
agaaaataggtgtcccgtaccggcaaaccgcacacaggtaantcaanatgagaattctaaggtgagcggagcgaactcncgttaaggaactcggcaaaatgaccccgtaacttcgggagaaggggtgctctttaggttaacgcccagaagagccgcagtgaataggcccaagcgactgtttatcaaaaacacaggtctctgctaaaccgtaagtgatgtataggggctgacgcctgcccggtgctggaaggttaagaggagtggttagcttctgcgaactacgaatcgaagccccagtaaacggcggccgtaactataacggtctagacgatctgc

SEQ ID NO: 4421 - DNA, 297 bp; double-stranded, linear
ggncaccctcgtgccaaacagtgctctacctccaataatcatcacttgaggctagccctaaagctatttcggagagaaccagctatctccaggttcgattggaatttctccgctaccctcagttcatccgctcacttttcaacgtaatcggttcggtcctccattcagtgttacctgaacttcaacctgaccaaggtagatcacctggtttcgggtctacgacaaatactaaacgccctattcagactcgctttcgctacggctccacatttactgcttaaccttgcatcaaatcgt

SEQ ID NO: 4422 - DNA, 400 bp; double-stranded, linear
gtacatcgtctaataataagttgacgatatcttgcaatgcatctttatctaaatgtaagaattcaacgatgccgttgaagcggttaaggaattcagggcggaagaattttttcatttcgtgcataatatctttttcttcagcgtcattgccattgccaaagccagcatttgatgtacaaataataattgtatttttaaagttgatgacattaccttgaccatcagtcaaattaccatcatccattacttgtaataacaatgttaaaattgtggattgcttttcgattcancaatagaatgactgagangggatacggcgacttttcagtaaacggattgaatggcatcatanccacataccagcgtggaccatcattttggaacagcgtgggcacatatc

SEQ ID NO: 4423 - DNA, 291 bp; double-stranded, linear
aagttgagtcgcatagctagtatgaaacgtggtgtgcgcatgggaactatcaagctttgaagatgtggtactacatgcgttgaattagggatcggtactttatatgaagacgtgctgcttccattaaatgagtgatgcgattttggcatgaaggtcaccttaaatgtacattgttgtaataaaattgcctataaatttttagcacataaaataagangngccaaccattgttagactataacaacggttggctctttaattgtaaaaagaaaaccatacgctatggtagtt

SEQ ID NO: 4424 - DNA, 400 bp; double-stranded, linear
aactgccaccacctggggncgtttccagaacctctatgcatttcaatcacagncaaatgtgcggttgacgttcaatgactacctgcaattcatcggtcagctcacaccctttacctgnctaaagtaccagtagacaatgtaggtattggacttgcatgagcatttttatncagtaatgggctttagatattttattaataccggccaatcatgctattcaaaccgccaatagctttattagcaacatttttacctaaatcagccgcagctcttcccatgtctttaccaatatctctaatccaatcatatgtttttgcatagccattttctaaaaccattaaatactgatttagcgttagaccatgccgaacttgaaattgcatcaaaacgatcgtgggct

SEQ ID NO: 4425 - DNA, 340 bp; double-stranded, linear
ctttgacaatttgtataccgtactatcttgcgcttattgaagtaatgaatgaaacacctaagatgataaaagcaacaggtggttttgcgaaaagtgaagtatggcgtcaaatgatgtcagatatatttgacacagagttagtggttcctgaaagttatgaaagttcatgcttaggtgcctgcgtgctcggacttaaagctgtaggtgacattgaagatttttcaatcgtttcatcgatggtcggtgccacaaacaatcatacgccgattgaagaaaatgcactgttaccaagantcgaatccattnttatcattaagcgtcttancagagatatgacaat

SEQ ID NO: 4426 - DNA, 292 bp; double-stranded, linear
ctgaagatgataaagatgcagatggtggcgagttgcacgtaacaattacggatcatgatgatttcacacttgataacggatacttcgangaattatcatcagacagcgattcagactcagatagtgactcagacagcgactcagactcagacagcgactcagactcagacagtgattcagattcagacagcgactcagattcagatagcgactcagattcggacagcgattcagactcagatagcgactcagattcagatagcgattcagactcagacagcgactcagattc

SEQ ID NO: 4427 - DNA, 307 bp; double-stranded, linear
aacagtgctctacctccaataatcatcacttgaggctagccctaaagctatttcggagagaaccagctatttccaggttcgattggaatttctccgctaccctcagttcatccgctcacttttcaacgtaatcggttcggtcctccattcagtgttacctgaacttcaacctgaccagggtagatcacctggtttcgggtctacgacaaatactaaacggccctattcagactcggctttcgctacggttcccacatttactggctaaaccttgcatcaaaatcggtaactcgncgggtcattctan

SEQ ID NO: 4428 - DNA, 354 bp; double-stranded, linear
gaccatacatcgtcatcgtttgcaccgtcaaatactggtgatgcaacgtgaataccaagatttttagcagccatacctaagtgtagctctaatacttgtccgatgttcatacgagatggtacaccaagaggatttaacatggatatcgatcgggacgtccatctggtgaagtgaaggcatatcttcttcagggaacaatcttgaggaaatggacacctttgttgaccatgtcggaccacacatgcttatgcaccaacatggaattttacgtttttggaangatgattattacacgtnactaattggtttacaccaggtgganaatgttatcgtcggccttgcttcacgattgga

SEQ ID NO: 4429 - DNA, 400 bp; double-stranded, linear
gtgnactatcngcttgtctatgataatattattctttgtacttgtttaaaagatattagactaaaactaaaaacagcagtaagatgatttatgattaaaactatcttactgctgttcactttttataatacttctgaatgtctcacttatacttctagtcacagatttaaataatcaaaagtgcacattattaaaatatcaatttcacactcaatgcggctcatcgcattcatttcttgtctagcaacgttctactctagcggaacgtaagtagctaccatctcgctaaggaactttcttgacctggtgacaaccgctgcgnctntctctcttcggctctcgcttactccatttagctccactaaactcgtgcggcccttcccgttcggcagatccaacg

SEQ ID NO: 4430 - DNA, 292 bp; double-stranded, linear
actgccatccttcaatcggnacgacatttttcttgttcccacatagtgagcccaaccgccaccattcacaccttgacagccacataacataactaagtttaagatngggggataaatcgtatctgagttaaaccaatggttaatacccgcacccatgataatcattgaacgcccttcagtatcgatagcgttttgcgcaaattctttcgctacttgaatgacaacactttgttttacgcctgaaatggcttcttgccaagcaggtgtatattttgattctgcatcgtcgtaa

SEQ ID NO: 4431 - DNA, 284 bp; double-stranded, linear
tgagccgnacatcgaggtgccaaacctccccgttcgatgtgaactcttgggggagataagcctgttatccccggggtagcttttatccgttgagcgatggcccttccatgcggaaccaccggatcactaagtccgtctttcgaccctgctcgacttgtaggtctcgcatcaagctcccttatgcctttacactctatgaatgatttccaaccattctgagggaactttgagcgcctccgttaccttttaggaggcgaccgcccagtcaaactgcccgcctgaca

SEQ ID NO: 4432 - DNA, 312 bp; double-stranded, linear
tatcattgtggtacgataaggcatatgttgtacctatgnatggtggaagagccttcagttgtcgctgcagctagttatggtgcaaagctagtgaatcagactggcggatttaaaacggtatcttctgaacgtattatgataggtcaaatcgtctttgatggcgttgacgntactggaaaattatcagcagacattaaagctttagaaaagcaaattcataaaattgcggntgaggcatatccttctattaagcgcgtgtggtggttaccacgtatagcgattgatacattcctggccaccagttctatcttt

SEQ ID NO: 4433 - DNA, 288 bp; double-stranded, linear
cggtactcgttaaggctgagctgtgatggggagaagacattgagtcttcgagtcgttgatttcacactgccgagaaaagcctctagatagaaaataggtgcccgtaccgcaaaccgacacaggtagtcaagatgagaattctaaggtgagcgagcgaactctcgttaangaactcggcaaaatgaccccgtaacttcggganaaagggtgctctttaaggttaacgcccagaagagccgcagtgaataagcccaagcgactgttttatccaaaacacaggtctctgct

SEQ ID NO: 4434 - DNA, 336 bp; double-stranded, linear
ggaccgaaccgacttacgttgaaaagtgagcggatgaactgagggtagcggagaaattccaatcgaacctggagatagctggttctctcnnaaatagctttagggctagcctcaagtgatgattattggaggtagagcactgtttggacgaggggcccctctcgggttaccaatttcagacaaactccgaatgccaattaaatttaacttgggaattcagaacatgggtgatnaagtccgtgtttcgaaaggaaacagcccagaccaccagccaagtcccaaaatatatgtttaatgggaaaaggtgtggcctttgcccaggacaaccaagaagtt

SEQ ID NO: 4435 - DNA, 304 bp; double-stranded, linear
attgacgccgcatttttacggaatgggaataaagcgacacaaaccgtcacgtcngtgttggtgtcatgacaaggtaatgcgagtgatctgatgtatggcttatcatggcaatctgttatggnctgactgatcggacgatgtatcattcgccaattcgtttacttgtcgttattcaggcacccgactatgttgtaggcaagactactcgcgaataatgagcatttcgctaggangtgtctaaatcattggctgcgttttaatgagcgtaatgaggaaggggcgtttaaaaagttggatttaacga

SEQ ID NO: 4436 - DNA, 305 bp; double-stranded, linear
aatatactccggtaaataaccgaagagttttgaatcattgttaaaaatggaattanagttctagtatctgttgggttttgaaataggtcataggataaaacaaatngagaatttgtcgctatttgtaaattgtatcctggcttaagttggccatttttcatatggtcttccttcattctcataaaagttgcatcatggatcagttttagaaaagctatttctatctttaagaatcgatttttgttcttcatatttattttttctttcggaataatcatcaaatttatntttggaacttcttaatc

SEQ ID NO: 4437 - DNA, 359 bp; double-stranded, linear
atcgtttaaatcagttagtaaaaagtctgtgagtaagggtgtatggaaagtggttaaatattatagaaaacatcaaaggatgttaagaaatacaatttattacccagcatttaataatggtgctatagaaggaattaataataagataaaattaatcaagtgaatttcttttggttacagaaatttcaacaactttaaagcacgtataatgatgattttcagcttgtacaaggggganaaaaggangncaaccaagcccaataatggactggccgcctaatattaaaaactctaaaggttgtattttaaaatagttctttaaattatatacccaccacatttggtggagacccgttaac

SEQ ID NO: 4438 - DNA, 286 bp; double-stranded, linear
acttacagttattttaacttggncagaatccatcatccataagttcgaaatgttgtaaaacataaaccttgnaaacggcaacatttttgggtccttctccatcattttatttaaaagcgcattatgatcaatatcatgcccaattaactttccagcaatttccatagtatgttctgaggtattgttaaaaaggaatcgcccagtatcaccgacgataccaagatataaaacgctcgcgatatctttattaacaattgcttcatcattaaaatgtgagattaaatcg

SEQ ID NO: 4439 - DNA, 394 bp; double-stranded, linear
tcgcttgacttctttcctctccttcggctctcgcttactcatttanctctactaaactcgttgcgctcttttctcgtttcgtcagattcaaacgttttcacttcgccaagccatttttctttgtgtttactttttattttgacgttttagacataaaaaaaagagaccttgcggtctcaatgcggctcatcgcatccattttttgcctggcaacgttctactctagcggaacgtaagttggctaccatcgacgctaagaacctttcttgacttgtgacaaatcgcttgcttctttcctcntcttcggtctcgcttactcatttagctctactaaactcgttgcgctcttttctcgtttcgtcagattcaacagttttcattcgccaagccattt

SEQ ID NO: 4440 - DNA, 295 bp; double-stranded, linear
taataggttcgaggtggaagcatggtgacattggcagctgacgaatactaatcgatcgaagacttaatcaaaataaatgttttgcgacaatgcaacttttacttactatctagttttgaatgtataaattacattcatatgtctggtgactatagcaaggaggtcacacctgttcccatgccgaacacagaagttaagctccttagcgtcgatggtagtcgaacttacgttccgctagagtagaacgttgccaggcaaaaaatggatgcgatgaccgcattgagaccgcagcntn

SEQ ID NO: 4441 - DNA, 345 bp; double-stranded, linear
tttcataaaaagatttcaaacgcgttcatcaancctcgtcgcaggtctttcgaacactagcgattatttcttatgaattcaagcttatttaaaactctttattcactcggttttgcttggtaaaatctatattttacttacttatctagttttcaatgtacaatttctttttagtcaagcgctcgcatactgctttattttcataagcaatatcactttaaccaaaaaatatttgaatgttaaataaacattcaaaactgaatacaatatgtcacgttattccgcatcttctgaagaagatgttccgaatatatccttagaaaggaggtgatccngccgnacctt

SEQ ID NO: 4442 - DNA, 313 bp; double-stranded, linear
aatcattgtcaaaactacgttctggtaaacaaggacaacccgtttgaaccattggcccacaccatttgataggcagncatgtgcgcaatggacatccacatagttgcgtaatgtttcatacgtcattgctcaaatcattcatgactagcgcaacatgattaccttgtcgtgngcaccttcattaaagnaacttatgatagatttatttcccgggacattaagcattcgcatcgttaacatgcgtattgcacccaatttagaagttcctccgtgccgtttggtatatcacaaatttgtagtgtatcttggatgc

SEQ ID NO: 4443 - DNA, 336 bp; double-stranded, linear
agcatggtgtttctcagattgtcggatgtataaatgtgtatgttatgttttaatttttcccagtctttaaaaatagattgtttatttttagaattatttttgaataattgaattgctttgtagccaaaatatgacgttcgattatcattcaaacgcatataaagcgtatctnctgcctcattgtcagtgagatgaaataatgtgctcggggtctagtgactgtggataatttcacttcaactgaaaccccattccctttgagctgcccatatatctctttggacaatatcggtccctctaatacggnccgtagnccattccatttcaattcttttc

SEQ ID NO: 4444 - DNA, 400 bp; double-stranded, linear
cagactgggatatttataaaacgttggcaaaagcattttcagaaatggcaaaagactatttacctggaacgtttaaagatgttgtgacaactccacttagtcatgatacaaagcaagaaatttcaacaccatacggcgtagtgaaagattggtcgaagggtgaaattgaagcggtacctggacgtacaatgcctaactttgcaattgtagaacgcgactacactaaaatttacgacaaatatgtcacgcttgggcctgtacttgaaaaaaggggaaatttggagcacctgggggtaagtttccgtgtccagttgaaccattatggagganttnaaaaagtatgttaagggacctgggagttgaatacccaatggatngattcccgtgaagagccgaatcc

SEQ ID NO: 4445 - DNA, 339 bp; double-stranded, linear
tacgcccacgacggatagggaccgaactgtctcacgacgttctgaacccagctcgcgtaccgcttgtaatgggcgaacagcnatcgccttgggaccgactacagccccaggatgcgatgagccgacatcgaggtgccaaacctccccgtcgatgtgaactcttgggggagataagcctgttatccccggggtagcttttatccgttgagcgatggcccttccatgcggaaccaccgggatcactaagtccgtgctttcgaccctgactacggacttgtnaggtctgcggcattcaagcttcccttgatggcctttgacactgcttatggaatgnatttg

SEQ ID NO: 4446 - DNA, 318 bp; double-stranded, linear
caattttaagtgttgaaaatgtcacttttaaactttctagttttatctttaataaacatgccatncgtaataagtggcgttttattaaaatcatctataatagccatatagttttgctcactaccataacctgcatcagctacaatatactccggtaaataaccgaaggatntttggaatcattgttaaaaatggaattgaaagttctagtatctgttgggttttgaaataggtcataggataaaacagggtgagaatttgtcgctatttgtaaattgtatcctggcttaagttggccatttttncataggtcttcct

SEQ ID NO: 4447 - DNA, 279 bp; double-stranded, linear
ttttgaaattctctatgttggggcccggactataattgaaaaatgcttgttacaagtgcattttatttcagtcaactactaacaatataacattgtggagcccaganctttgattaatgtatatgaaaatcaaagtaatgcttatgtatgattatttcaaatattttacatacatgaacttttccaatgtacgatactattattataaagcgctcgctaagattttacgatgattagagggtaaaaaatgaacgatcaatggtntaaccatttaattgg

SEQ ID NO: 4448 - DNA, 302 bp; double-stranded, linear
gacaccggcattctcactttctaagcgctccacatgtccttacgatcatgcttcaacgcccttagaacgctctcctaccattgtccaaaggacaatccacagcttcggtaatatgtttagccccggtacattttcggcgcagtgtcactcgactagtgagctattacgcactctttaaatgatggctgcttctaagccaacatcctagttgtctggggcaacgncacatccttttccacttaacatatattttgggacctttagctggtggtctngggctgttttctgnattgaacacggga

SEQ ID NO: 4449 - DNA, 359 bp; double-stranded, linear
cgttggtatatagagggcaaccgtcacctgataaaatgtggacacagtttttacaagaggttaaggaaatgagtttggaggcatacgagcatcaagaatacccattcgaatgtttagtaaatgacttagatcaatcacatgatgcctcacggaatccattatttgatgtcatgttagtactacaaaacaatganacgaaatcatgctcattttgggcatagtaaatttaacacacattcaaccccaaatcagtgacgggcggaaatttggatttntccttttccatcattggaagaaggatcgcggatgacctaatancaatccaattatcggggtataaataccggattttataacca

SEQ ID NO: 4450 - DNA, 326 bp; double-stranded, linear
gatgacaaaatttgcttgaaaaccgaaatggatggtcatcattgactgnatcaaggtacatcattctttggtgcttatgcatttagacattatacaaaaacaatacttttatagggcaaccttatggggttctatcggctatacattacctgcaacattaggttcacaattagcagacaaagatcgtcgntaacttattattaattggtgatggctcattgccaactaactgttcaagctatttcaactatggattagacagcatattaaaccggtattatttgtggattaataatgacggctatacggtagaacgacttattccc

SEQ ID NO: 4451 - DNA, 381 bp; double-stranded, linear
gaaaacatcaaaggatgttaagaaatacaatttattacccagcatttaataatggtgctatagaaggaattaataataagataaaattaatcaagtgaatttcttttggttacagaaatttcaacaactttaaagcacgtataatgatgattttcagcttgtacaaaggaganaaaaagaagacaaccaagcccaataatggactggccgcctaataataaaaactctaaaagttgtattttaaaaataggtctttaaattatataccccccccatttgggtggagaaccggtaaaccatgcctaggtgcctaacctccnataatggnacccctccttaccatttgggccatggggccaataaagcggggggcaattgggg

SEQ ID NO: 4452 - DNA, 276 bp; double-stranded, linear
ttaataacttaatctatgtttccatcctacaggaaacgcgttattaatcttgtgagtgttctttcgaacactagcgattatttcttatgaattcaagcttatttaaaactctttattcactcggttttgcttggtaaaatctatattttacttacttatctagttttcaatgtacaatttctttttagtcaagcgctcgcataagcaatatcactttaaccaaaaaatatttgaatgttaaataaacattcaaaactgaatacaatatgtcacatn

SEQ ID NO: 4453 - DNA, 341 bp; double-stranded, linear
ggcgaaaccgcgtagcgttttttaagtctgatgtgaaagcccacggtcaaccgggagggtcattggaaactggaaaacttgagtgcagaagaggaaagtggaattccatgtgtagcggtgaaatgcgcagagatatggaggaacaccagtgagcgaagcgactttctggtctgtaactgacgctgatgtgcgaaacgtgggggatcaaacaggattagataccctggtgagtccacgccgtaaacgatgantgctaaatgttagggggtttccgccccttagtggctgccagctanacgcattgaagcactgccgcctggggagtgacgaccgcaanttga

SEQ ID NO: 4454 - DNA, 281 bp; double-stranded, linear
acnctccccaaagtcatatcgtcgttagtaacgtccttcatcggcttctagtgnccaaggcatccaccgtgcgcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgagtgttctttcgaacactagcgattatg

SEQ ID NO: 4455 - DNA, 279 bp; double-stranded, linear
atgtcttcacttatacttctagtcacagatttaaataatcaaaagtgcacattattaaaatatcaatttcacactcaatgcggctcatcgcattcatttcttgtctagcaacgttctactctagcggaacgtaagttagctaccatcctcgctaagaacctttcttgacttgtgacaatcgcttgcntctttcctctccttcggctctcgcttactcatttagctctactaaactcgttgcgctcttttctcgtttcgtcagattcaaacgttttcngt

SEQ ID NO: 4456 - DNA, 275 bp; double-stranded, linear
attttgacgttttaggcataaaaaaaagagaccttgcggtctcaatgcggctcatcgcatccattttttgcctggcaacgttctactctagcggaacgtaagttggctaccatcgtcgctaaagacctttcttgacttgtgacaatcgcttgcttctttcctctccttcggctctcgcttactcatttagctctactaaactcgttgcgctcttttctcgtntcgtcagattcaaacgttntcacttcgccaagccatttttcttgtgtttactt

SEQ ID NO: 4457 - DNA, 400 bp; double-stranded, linear
atccgattcacaaagcacatcatcatatacaagtcagtcaacaagccaaagtgaatccacatcgacatcaacgtcactaagcgattcaacaagtatatctaaaagtacgagtcaatcaggttcggtaagcacatcagcgtcattaagtggttcagagagtgaatctgattcacaaagtatctcaacaagtgcaagtgagtcaacatcagaaagtgcgtcaacatcactcagtgactcaacaagtacaagtaactcaggatcagcaagtacgtcaacatcgctcagtaactcagcaagcgcantggaatccgatttgtcgtcaacatctttaagtggattcaacatctgcgtcnatgccaaagnngtgaatccgattcacaaagcacatcagcatccttaa

SEQ ID NO: 4458 - DNA, 351 bp; double-stranded, linear
gagtgcactgtctggaatctggactcactgatctgattctggagtcgctatctgattctgagtcgctgtctgaatctgaatcactgtctgaatccgaatcgctatctgattctgagtcgctatctgaacctgagtcgctgtctgagcctgagtcactgtctgaatccgaatccggatccgggtctggggntggttccggttctgggtctgggacttggttctggatctggcgttggttctgggtctggggtctggactggttctggggtcaaacggcggccctggagtggggtctttcggaatnaacggcggaatcaccatcaagcaacttncaacaaccataacgaaaaa

SEQ ID NO: 4459 - DNA, 271 bp; double-stranded, linear
atcctgcagttgatcagtatggtgatattaatttagttaatacgaacgcgtcatctacaagtgaaatcatttacgatttaatctcacattttaatgatgaagcaattgttaataaagatatcgcgagcgttttatatcttggtatcgtcggtgatactgggcgattcctttttnacaatacctcagaacatactatggaaattgctggaaagttaattgggcatgatattgatcataatgcgcttttaaataaaatgatggagaaggnccc

SEQ ID NO: 4460 - DNA, 283 bp; double-stranded, linear
actgtggattaatattatgcctggcaacgttctactctagcggaacgtaagttcgactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcanaacatttattttgattaagtcttcgatcgattagtattcgtcagcgccacatgtcaccatgcttccacctcgaacctatnaacctcag

SEQ ID NO: 4461 - DNA, 274 bp; double-stranded, linear
cttctacaagtcctgaatatacttatgaatctcttctttcgtgtatgcaaactgacgttgtaatttaaataacgtctcatctttccattgcgaatcttgatattgtatattttcaaaatcaaagtcaactttatggttatcaatccacgctttatatggtaattctccagcaatcgcaccttttaaatcattattttcaatgactttattctgttaaaatcaacaancataactttccnggattcaattgacctttaaaagcaacattacttcc

SEQ ID NO: 4462 - DNA, 271 bp; double-stranded, linear
ggctgctaaaaatcttggtattcacgttgcatcaccagtatttgacggtgcaaacgatgacgatgtatggtcaacaattgaagaagctggtatggctcgtgatggtaaaactgtactttatgatggacgtacaggtgaaccattcgataaccgtatttcagtaggtgtaatgtacatgttgaaacttgcgcacatggttgatgataaattacatgcgcgttcaacaggaccatattcacttgntacacaacaaccacttggcggtnaagcg

SEQ ID NO: 4463 - DNA, 300 bp; double-stranded, linear
gcggctcatcgcattcatttcttgtctagcaacgttctactctagcggaacgtaattagctaccatcctcgctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttantttgacgttttagacataaaaaaagagacctcacggnctcaacttgcctggcaaaggtctantcta

SEQ ID NO: 4464 - DNA, 361 bp; double-stranded, linear
taccgaatcgaagccccagtaaacggcggccgtaactataacggtcctaaggtagcgaaattccttgtcgggtaagttccgacccgcacgaaaggcgtaacgatttgggcactgtctcaacgagagactcggtgaaatcatagtacctgtgaagatgcaggttacccgcggacaggacgggaaagaccccgtgggagcttttactggttagcctggatattggaaattcgggcacacttggttacaggataggtaaggagccttttggaaacgttgagcgctactttangttgggaggcgctggtngggatacttaccctaactgtgtttggcttttctnaaccggcaccacttatcctgg

SEQ ID NO: 4465 - DNA, 292 bp; double-stranded, linear
ctgtatgtacaccaccaatcggtttaggtttagcaacgtttgttcaaaagtataaattcaatcattccgaaagagaaatgggtaaggcttccttcactatgggactatttggtattactgaaggtgctattcctttcgcagcccaagatccattgcgcattatacctgcaaacatcattggtgcaatgattgcatcagtcattgcagccattggtggtgtcggcgatagagtcgcacatggnggtcccaatcgtggctgtattaggtgggtttttgtttttttttntttttt

SEQ ID NO: 4466 - DNA, 308 bp; double-stranded, linear
gcaaacaaaacagtattagtagattatgaaaaatatggtaagttttataacttatctattaaaggtacaattgaccaaatcgataaaacaaataatacgtatcgtcagacaatttatgtcaatccaagtggagataacgttattgcgccggttttaacaggtaatttaaaaccaaatacggatagtaatgcattaanagatcagcaaaatacaagtattaaagtatataaaagtagataatgccnctgatttatctgaaagttactttgtggaatcccggaaaccttgagggtggcccctaatantgg

SEQ ID NO: 4467 - DNA, 271 bp; double-stranded, linear
aagcaggcgctctcccagctgagctaagcccccataataattacagtatatcgggaagacaggattcgaacctgngaccccttggtcccaaaccaagtgctctaccaagctgagctacttcccgtataattaangcgcccgataggagtcgaacccataacctcttgatccgtagtcaaacgctctatccaattgagctacgggcgcatatgtttttattgaaaatagtgccgaggaccggaatcgaaccggtacgtgatcactcaccgca

SEQ ID NO: 4468 - DNA, 306 bp; double-stranded, linear
tgtgttaggtattacatcatcacatttatctgcgtcaaagtccagctgtcgataaagttgtaaactgtaaaaacgcaatttctgaattagaaaatgataaacgtaaagcagtaagtgctgaagantataaaaaagctgacgacattcaaaatgaaatcaaatcattacaagataaattagaaaatagtaatggtgaacatactgctgttgctacagttcatgatatttcagatactattcaacgattaactggtattccagtttctcaaatngatgataacgntattgaacgtttaaaaaatattt

SEQ ID NO: 4469 - DNA, 329 bp; double-stranded, linear
ggtttattaacagcattcttatcagcatttgtaactgttattgtttataacttctgtgtgaagcgcaatattacaattaaaatgccgaaagaagtaccgccgaatatttcacaagtatttaaggacttaattccattttcagcggtaatcatcattctttatgcattagatttagtcattcgcaacagctttaaatcaaatgtagcggaaggtattttaaaattattcgaaccattatttacagcagcagatggatgggttggtggtcaccatttaacnttgggngcntttgcattaatcctgggtttgtagggtaatccatgggtccg

SEQ ID NO: 4470 - DNA, 400 bp; double-stranded, linear
aactgggtgataaggtcctgttcgaaaggaaacagcccagaccaccagctaaggtcccaaaatatatgttaagtggaaaaggatgtggcgttgcccagacaactaggatgttggcttagaagcagccatcatttaaagagtgcgtaatagctcactagtcgagtgacactgcgccgaaaatgtaccggggctaaacatattaccgaagctgtggattgtccttggacaatggtaggagagcttctaaggacttgaagctgatcgtaagactgtggagcgntagaatgagatgccgtgtgatagnaaagacggtgagatccctccaccgttgactaagttccagaggaagctctccgtcgggttatccggtcctaagngaggccgacagctaggcatggnt

SEQ ID NO: 4471 - DNA, 325 bp; double-stranded, linear
tcatttttagaaatattatcttttccacaaatcatttgatataaagtgcgatcatttgccgcgagtgctgccattgacactagctgttgcgtatcatttttggctagcacttcgggatactttcttagctgaacagttagatgacctaattgatctttgaaaatatcattatcttgacccatatatgaccaccaagctgtttcatcacaaaccatgacatacttagctagtgcttcatctttttctataagctgacgtaataattgtctgcttgtcctccgttttncatgtaccgcgaggcgtaancttaaagggcccaaggncg

SEQ ID NO: 4472 - DNA, 276 bp; double-stranded, linear
cccgtctttcgctactcacaccggcattctcacttctaagcgctccacatgtccttacgatcatgcttcaacgcccttagaacgctctcctaccattgtccaaaggacaatccacagcttcggtaatatgtttagcccggtacattttcgggggcagtgtcactcgactagtgagctattacgcactctttaaatgatgggctgcttctaagncaacatcctagttggtctggggcaacgccacatcctttttccactttaacanatattttggga

SEQ ID NO: 4473 - DNA, 333 bp; double-stranded, linear
aatttnccaaaaaattcaaatggctcatttaccaaaaggtaaacctccgcctttaantttcttaatgcatkgtctaacaaccgctttctttaaaagaatagattgtcaagcgctcgcataagcaatatcactttaaccaaaaaatatttgaatgttaaataaacattcaaaactgaatacaatatgtcacgttattccgcatcttctgaagaagatgttccgaatatatccttagaaaggaggtgatccagccgcaccttccgatacggctaccttgttacgacttcaccccaatncatttgtcccaccttcgacgggctagctccgaaaagg

SEQ ID NO: 4474 - DNA, 325 bp; double-stranded, linear
tataaaatagcaacgttattccaattatcttaatggttatcttatcctcaactaaattggaggaatcactatgacaattaataaagtaaccgttcttggcgcaggcacaatgggcgctcaactggcagcactttttgtgaatgctggacttaaagtaanactattagatattgtagtggacaaaaacgatccnaatctcattgcgaaaaaatcttacggttaaattacaggtaagaaacggccgctactattcgncttaaatctagcggtcatttaccatatggtattttgatgtgcttggtaaatgtgtgctgtttgatatcga

SEQ ID NO: 4475 - DNA, 308 bp; double-stranded, linear
taactgcggcaacatttgcttgttttggttatggttggcacattgatgtcggcattcatacaatacatctagtattatctggtatttttgatcgttatccaaagttaaataatgattattggacattggggtgagtttatcccattcttcttagaaacgtatggatgaagcttattcgctgacatttnaccaccctgtaagctatactttaaaaataatttttaatcacaccgagtggcatgttaacgagccacagtttgatttagtcaagaagnagaggtattgtagantcttatgcgctgatatcc

SEQ ID NO: 4476 - DNA, 280 bp; double-stranded, linear
atgatatgctgtatatcccaccagcgcctccacgtaactagcgctcacgtttcaaaggctcctacctatcctgtacaagctgtgccgaattncaatatcaggctacagtaaagctccacggggtctttccgttcctgtcgcgggtaacctgcatcttcacaggtactatgatttcaccgagtctctcgttgagacagtgcccaaatcgttacgcctttcgtgcgggtcggaacttacncgacaaggaatttcgctacctttaggaccgttatagttacgg

SEQ ID NO: 4477 - DNA, 279 bp; double-stranded, linear
gctaagaacctttcttgacttgtgacaatcgcttgcttctttcctctccttcggctctcgcttactcatttagctctactaaactcgttgcgctcttttctcgtttcgtcagattcaaacgttttcacttcgccaagccatttttctttgtgtttactttttattttgacgttttagacataaaaaaagagacctcacggnctcaacttgcctggcaacgttctactctagcggaacgtaattgggctaccatcgncgctaaagacctttcttgacttg

SEQ ID NO: 4478 - DNA, 272 bp; double-stranded, linear
gaggatcccggaatgttgaacccatcactgattctggttcataattatccatcatccataacgttaaatctaaagcgtgtgtaccgatatcgattaatggtcctccaccttgagcttcttcgtctagaaagacaccccatgttggnactgctcgacgacgaatggcatgtgcctttccgaagtaaatgtctcctaagtcgccacgttgcgctgcttgatgtaaaaattgactatctgctcgganacgattttgataacctattgttaatttt

SEQ ID NO: 4479 - DNA, 265 bp; double-stranded, linear
gaaattgggaatccaattttnctttgttggggcccatccccaacttgcacattattgtaagctgacttttcgtcncttactgtgttggggccctcaccccaactcgcattgcctggtagaatttcttttcgaaattctctgtgttggggcccctgactagaattgaaaaaagcttgttacaagcgcattttcgttcagtcaactactgccaatataacttcgtagagcatagaatattgatttatgtcccagcctgagttaattt

SEQ ID NO: 4480 - DNA, 343 bp; double-stranded, linear
acatagaaatgccacttttacaaacaaatgaatattcgtctttttacatcattacgcataataaaagaagctaagcaacatgtaaaccgttgtcacttaacttcttgtttttccgatgacagcttctatttagagaatgtcatgattattttatattcacttcaatgttatcaatattagtgccatctatgacgtctgccatacgatgctctggcagttttttggtggtaattcaaacgtatattcccaccgttttcatttaataacgttgtccnggacccatgtaccgtaagatatgttttcatagtggttccaattaaaccantcttcaggaacctcntag

SEQ ID NO: 4481 - DNA, 288 bp; double-stranded, linear
actgcggcaatagcagcagcaccacaaacggcctgtgtccggacacctaggtaataatgcgcatgtttttgtcaccatgccaacagtttgttgacaaagagcatcattacaatactggaaaataacgacacctacatcgatggctaatagtttactaccttgaccgataatatcgaatatattgagtttaagtccatataggatgattgcaaatcttaataaatatttagatgaaaacgtaatacctgagctatattgntcaggatatcctctagagtgacgatanag

SEQ ID NO: 4482 - DNA, 289 bp; double-stranded, linear
gaggcatccccgggccttccttcccaacagtcgcttcaaagtttggtggtaaacctgntacatcaaattatcggtgctactgtnaggtacgtgtaatcttcgctattttattagccgtatcacatcaagtggcttccctactggaaccaatttgctattcgccttattatcaggtgcaggatggggattcggacaaatcattacatttaaagcgttcgaattagtcggctcatctcgtggccatgccagtcacaacagcattccaattattaggcgcatctttatgggg

SEQ ID NO: 4483 - DNA, 264 bp; double-stranded, linear
aatcaaaagtgcacattattaaaatatcaatttcacactcaatgcggctcatcgcattcatttcttgtctagcaacgttctactctagcggaacgtaagttagctaccatcctcgctaagaacctttcttgacttgtgacaatcgcttgcttctttcctctccttcggctctcgcttactcatttagctctactaaactcgttgcgctcttttctcgtttcgtcagattcaaacgtttncacttcgccaagncatttttctttg

SEQ ID NO: 4484 - DNA, 261 bp; double-stranded, linear
ctgtaccacctataatcgttttaatcgattgggggacgcataggataggcgangtggcgattggattgcacgtctaagcagtaaggctgagtattaggcaaatccggtactcgttaaggctgagctgtgatggggagaagacattgtgtcttcgagtcgttgatttcacactgccgagaanaagcctctagatagaaaaaggtgcccgtaccgcaaaccgacacaggtagtcaagatgagaattctaaggtgagcgagcga

SEQ ID NO: 4485 - DNA, 261 bp; double-stranded, linear
atgcagctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggantaaatcttttaaggcttataaacgctcatctgacattgtagangtcatgctttcaaaagacgatatactacgac

SEQ ID NO: 4486 - DNA, 260 bp; double-stranded, linear
agcaacatgatgcacttctcgtgtctcaccagatttagcgactaaacttgtagacatacgtaaatctgctttaataagtaattnatgcacatgacttattgcgagtaacatcggcattgcaaagccattgctatcaactaatccactatcatctaacactagantttgagcgccttgctttacagcattcactgcttctcggcctaatgcttctaacgcatcttccaaatccccttcatataccgttgataaataagtta

SEQ ID NO: 4487 - DNA, 316 bp; double-stranded, linear
atgaggtgcatagggataaaacagnnagcagcaatttgtcgctatttgtaaattgtatcctggcttaagttggccatttttcatatggtcttccttcattctcataaaagttgcatcatgatcagttttagaaaagctatttctatctttaagaatcgatttttgttcttcatatttattttttctttcggaataatcatcaaatttatttttgaacttcttaatcttagttcttttttacgggtctgttttccaatttgagtactatcctcgttccccaatagaatgaatttaaaccttccgatttcctttaanc

SEQ ID NO: 4488 - DNA, 307 bp; double-stranded, linear
cacttttactgctaaaacgtcaattgttgatgagtcgtgttttatctcaagatgtgttactcaaaaagttatagaagaagctactaaagttaaaacagagattgatactgccagaagataactgtatctctccatctactgtaagtccgtattagaactaaagcggctaattcattacgaattaaaccctttaattgtttgccagacacatcgctatggatgaatttaaagcgtnaaaatgtactggatcatgagttcatttttatagntatgtacncatgtgtatagtatttagaaatagactcaa

SEQ ID NO: 4489 - DNA, 344 bp; double-stranded, linear
ttggcaaatgtcatataactagtaacatgatcatcgacatcaaatttagtatgatcaaatgttccccaatcattaatttgattcggttgtttgctcaattgattatatgtttttcctagcacttcatgcggcaccatatctttacctagtagccccacaaagataagtctaacaagtggcaccataatcgataaactaccgccacctgcacgcttatggtaaaacacccagccagcacttacgctacgcatcgctgtacacgtgctactaaggttaccaccacactgattcaatgctttttagcagtatgccacnccggngacgatatggtagcgacgtaanaa

SEQ ID NO: 4490 - DNA, 313 bp; double-stranded, linear
cccaaccggcacattgttgtaagctgactatatgtcacttcntgtgttggggcccctgtcttcgactggcactgctccctcaggagtctcgccattaatactacgtattaacatgtaattttacttttaaatactttaaaaaaataagacactttggtccaacttaagccagggatacaatttacaaatagcgacaaattctcaatttgtnttatcctatggacctatttcaaaacccaacaggtactnagtaactttgaattccattttttaacaatggattgcaaaatgaccttacggttcatttgaccgg

SEQ ID NO: 4491 - DNA, 291 bp; double-stranded, linear
aggtctgactctagaggatccccgatgagtttaaagaaaaatatcaaacacctgaattatattttaaagcttggcaaggtttttaccacgaggttcacaatgagccagaacgtgatgaagtaatgcgttatattctgactttcttaaataacagcgtcaatacaatgggctttattgttgaagatgacgaaattgtagaaatttaatattctaaaaaggttgggacataaatccctaaaaaacagcagtaagataattttccattagaaaatatcttactgctgtgcncna

SEQ ID NO: 4492 - DNA, 400 bp; double-stranded, linear
gccgtctcagccttggtcttcgactggcactgctccctcaggagtctcgccattaatactacgtattaacatgtaattttactttgaaatacttaaaaaaataaaacactttgcccaacttacactaccaatagaaactgctgttagaattcctcaaaatgatatttcgcgatatgttaatgaaattgttaaaaagatagctgatagcgagattcgatggaattcagacatcatcgtgggcgcaacatcctatcatctaaaaatgatgttaaaaatcacctgcatattgcatatactgcaatctggaattttctgggccgtgagaatgagaaaaatngacntcatgaacagtgattgcgaatggatgtgggttaagctncaagattcaaacaccttgcnt

SEQ ID NO: 4493 - DNA, 265 bp; double-stranded, linear
tgatccagagatttccgaatggggaaacccagcatgagttatgtcatgttatcgatatgtgaatacatagcatatcagaaggcacacccggtagaactgaaacatcttagtacccggaggaagagaaagaaaattcgnttcccttagtagcggcgagcgaaacgggaagagcccaaaccaacaagcttgcttgttggggttgtaggacactctatacggagttacaaaggangacattagacgaatcatctggaaaggtgaatca

SEQ ID NO: 4494 - DNA, 293 bp; double-stranded, linear
cattactaaaaaagataatcaaggtatgatttcacgcgatgtttcagaatacatgattactaaggaagagatttccttgaaagagcttgattttaaattgagaaaacaacttattgaaaaacataatctttacggtaacatgggttcaggaacaatcgttattaaaatgaaaaacggtgggaaatatacgtttgaattacacaaaaaactgcangagcatcgtatgggcagacgtcatagatgggccctatattgataccattggaggtgaatntaaataaccatgcactctc

SEQ ID NO: 4495 - DNA, 256 bp; double-stranded, linear
acttacaaagttctgtgaaccaagtaccatcaactgctggtatgacgcaacaaagtattgataactataatgcgaagaagcgtgaagcagaaactgaaataactgcagctcaacgtgttattgacaatggcgatgcaactgcacaacaaatttcagatgaaaaacatcgtgtgcgataacgcatttaacagcattnaaaccaagcgaaacatgantttaactgcagattacacatgccttaggagcaagcagtgca

SEQ ID NO: 4496 - DNA, 254 bp; double-stranded, linear
gtcatcagaaacccttgtcacacaaggcttgtattttttatacttattttttaaattaaattcatcattatctaatttaaaacaatatactaaacgtttcataattatcgcctgtacaatacgcacaaaaacatgtcttgaaacgcctttcattactctaanatacccaatatactttttatatcgttcggattctgagtatttcagacgattttctgcatanaaataaacgtgtttcaaggcaatatattgca

SEQ ID NO: 4497 - DNA, 269 bp; double-stranded, linear
aatcggctgtctgattctgaatcgctatctgagtccgaatcgntatctgaatccgagtcgctatccgagtctgagtcgctatctgaatccgagtcactgtcggagtcggaatcactatctgaatccgaatcactcgctgaatccgaatcactgtctgagtctgagtcactgtcggaatctgagtcactgtcggaatctgaatcgctatctgaatccgaagtcactggtcgggaatctgagtcactgtnggaatctgaatcgctatctga

SEQ ID NO: 4498 - DNA, 273 bp; double-stranded, linear
caccccggcactataaaaatggagcagaagacgggattcgaacccgcgaccccaaccttggcaaggttgtattctaccgctgaactacttctgcatatgcgggtgaagggagtcgaacccccacgccgtaagcttagnatacctcaagtctagtgcgtctgccaattccgccacacccgcaaatggtgagccatagaggattcgaacctctgaccctctgattaaaagtcagatgctctaccaactgagctaaatggctcttncaggtgccgg

SEQ ID NO: 4499 - DNA, 314 bp; double-stranded, linear
gtagtaaaacgcatttagtgattgaaacaggcaagatagacgcgggatatcacggcaatttagggattaatatcaagaatgacgctattgcatcgaatggttatatcacaccaggtgtttttgaatattaaaaggagaatcgatttgaagtgcnncataagacaatacggacttatcaaatcaacgaaggagacaaactagctcaattggttatcgtgcctatatggacacctgaactaaagcaagtggaggaattcgaagttgttcanacgtggagaaaaggctcggagagcgggtgaaagcatcttagtcga

SEQ ID NO: 4500 - DNA, 304 bp; double-stranded, linear
attgtaaggctatcatgtcaaagattataacaataaatctggttgagatttggtggcggggcgatggaagctatctatttgaccatccatttggcaaaggtttgggagttacacaggtggacttaactttaatggcggtcgtcactatggtatcgactttggtatgcctacaggaacgaaccatttatgctgttaaaaggcggtatagctgataaagtatggnctgattacggtggcggtaattctatacaaattaggaccggtgctaacgaatgganctggtatatgcatttatctangcatt

SEQ ID NO: 4501 - DNA, 253 bp; double-stranded, linear
ttccttcattctcataaaagttgcatcatgatcagatcagttttagaaaaactatttctatctttaagaatcgatttttgttcttcatatttattttttctttcggnataatcatcaaatttctttttgaacttcttaatctcagttatttttttacgggtctgttttctaatttgagcacaatcttcgttctcaataagaatgatttaaatctncgatttctttatctaaatggactaccaattaaatctat

SEQ ID NO: 4502 - DNA, 257 bp; double-stranded, linear
agttcggtccctatccgtcgtgggcgtaggaaattttngaggagctgtccttagtacgagaggaccgggatggacatacctctggtgtaccagttgtcgtgccaangcatagctgggtagctatgtgtggacgggataagtgctgaagatgcttaagcatgaagcccccccaagatgagatttcccaacttcggttataagatccctcaaagatgatgaggttaataggttcgaggtggaagcatggtgacatgtgg

SEQ ID NO: 4503 - DNA, 270 bp; double-stranded, linear
atacgtttaatacacaaaaaactgcaaagcatcgatggcagacgtcatagatggcactaatattgataacattgaagtgaatatanaataatcatgacattctctaaatagaagctgtcatcggaaaaacaagaagttaagtgacaagntttacatgttgcttagcttcttttattatgcgtaatgatgtaaaaagacgaatattcatttgtttgtaaaagtggcatttctatgtcttaaaagtgacgaaacttcaaatgtgccaagtgt

SEQ ID NO: 4504 - DNA, 251 bp; double-stranded, linear
taccttgaccgaagttcttacctacatcacctaaattaatgacatgtccaccagtcatatactctaatccatggtcgccgataccttcaacgacaacatctacaccactatttctaatacagaatctttctcctgcactaccgttaataaatgccttaccacttgtcgcaccatagaatgagacgttaccagcaataatttcattttgtcgttcttcaaaaggtgctttgacaatgaccgtaccaccngnt

SEQ ID NO: 4505 - DNA, 260 bp; double-stranded, linear
agaagttaagctccttagcgtcgatggtagtcgaacttacgttcccgctagagtagaacgttgccaggcaaatgacaaatcggagaattagctcagctgggagagcatctgccttacaagcagagggtcggcggttcgaacccgtcattctccaccatttattcttagatatagccggcctagctcaattggtagancactgacttgtaatcagtaggttggggggtcagtcctctggccggcaccatcttttgnccata

SEQ ID NO: 4506 - DNA, 313 bp; double-stranded, linear
ttctttagtagatactaaggcgttattagacgcattagacaatggtgtgattaaaggtgcagcacttgatacgtatgaatttgaacgcaaacttttcccaagtgatcaaaggggcaaaacactgaacgatccattgttagaatcgttgattgacagggaagatgtcatattaacaccacatattgcgttttatactgaagctgcagttaaaaatctattgtcgtgcattaggtgcaacattaggtgtattgcagcttggggaacttngntacgggtaaatttaaaatcggctgtgggtattttggnttttggg

SEQ ID NO: 4507 - DNA, 252 bp; double-stranded, linear
gncaatacggccaattcctaagattgctacttctgggtggattgataactggagtgaaccattgtccaccagctgnaaccgatattactgattgtgcatgtagcacctttcatttcatcggctgttaatttaccatcacgtggctttaacagctaattcattaatttcatctgaaatttgggaaaatagacttacggatcagcatgtttaacaacaggtactaataatcctctatcagtgtctgctgcaatt

SEQ ID NO: 4508 - DNA, 268 bp; double-stranded, linear
catcgaaccagatgtactcgcacttgttgagtctgatgttgaatcactaacactatcagataatgacgttgaatcactcatacttgttgatgtacttgtcgaaagcgacatactttgtgaatcactagtacttgtacgcatcgaagtactagttgaagctgatgtactacgagagtcacttgttgatgttgatgtacttgctgatcctgatgcacttgtacttcttgatgtgctttgtgaatcggatttcgctcgtgcntggtactng

SEQ ID NO: 4509 - DNA, 296 bp; double-stranded, linear
cgagagtgcgttaattcggttactgctatcacgtaaggggcggaaaccccctaacacttagcactcatcgtttacggcgtrgactaccagggtatctaatcctgtttgatccccacgctttcgcacatcagcgtcagttacagaccagaaagtcgccttcgccactggtgttcctccatatctctgcgcatktcaccgctacacatggaattccactttcctctgctggcactcaagttttccagtgtccaatgaccctccacggttgagccgtgggcttncacatcacacttana

SEQ ID NO: 4510 - DNA, 257 bp; double-stranded, linear
ttactacttactgagtgacctgtacctgctttcggagtaattgtgattgatgaatttggttttatagtattggcattgaacgtcactttaccagtttgtgcatctaacgttacatagtcaggcttattcgcaattgtccattgnttattttgaccacgaacaacattaattgtcttactatgttgctgcaccattacccacttnttcagtgtaagcaatatccattgcttgagttgggattaattaaatggtcctga

SEQ ID NO: 4511 - DNA, 250 bp; double-stranded, linear
aaaatcacatcagcctgcattaacgacgtcgttaatttatatacatctcctgtagtatctagataattctttccaacgctaaattctaattcaagttctcgtaaatccatcaactctatttgatgtccctcattgatgacttctagttcattttttaaatcatccatagcaattctcgttttagaacctactgtggaacctgacaataatacaatattcangangacgcccctcctattttgataaatgc

SEQ ID NO: 4512 - DNA, 253 bp; double-stranded, linear
agctggnttcgaaccaacgagtgacggagtnaaagtccgttgccttaccgcttggctatagcccaatatatagatggtggaggggggcagattcgaactgccgaacccgaagagcggatttacagtccgccgcgtttagccacttcgctacccctccagcttattcatataatttaataatcaaaatggtggaagaatgacgggttcgaaaccgccgaccctctgcttgtaaggcagatgctctccccagctg

SEQ ID NO: 4513 - DNA, 252 bp; double-stranded, linear
gncgacccttaataacttaatctatgtttccaccatttttataagtcaaacgttaacatgnaagttacgttcttttataaaaagatttaaacgcgttattaatcttgtgcagtgttctttcgaacactagcgattatttcttatgaattcaagcttatttaaaactctttattcactcggttttgcttggttaaaatctatattttacttacttatctagttttcaatgtacaaataatggtggagactagc

SEQ ID NO: 4514 - DNA, 244 bp; double-stranded, linear
gtcattgaatatggaaactttagaattacaaggcgctaaattacgataccaccaagtcggacaaggacccgtgctcatctttattcctggtgcaaacggtaccggagacatttttctgcctcttgcagaacagttaaaagaccattttactgttgtagccgttgatcgtcgtgattatggagaaagcgagttaactgaaccactccctgattccgcttcaaaccctgacagtgattatcgtgtc

SEQ ID NO: 4515 - DNA, 243 bp; double-stranded, linear
tattaggcaaatccggtactcgttaaggctgagctgtgatggggagaagacattgtgtcttcgagtcgttgatttcacactgccgagaaaagcctctagatagaaaataggtgcccgtaccgcaaaccgacacaggtagtcaagatgagaattctaaggtgagcgagcgaactctcgttaaggaactcggcaaaatgaccccgtaacttcgggagaaggggtgctctttagggttaacgccca

SEQ ID NO: 4516 - DNA, 267 bp; double-stranded, linear
actagtcgagtgacactgcgccgaaaatgtaccggggctaaacatattaccgaagctgtggattgtcctttggacaatggtaggagagcgttctaagggcgttgaagcatgatcgtaaggacatgtggagcgcttagaagtgagaatgccggtgtgagtagcgaaagacgggtgagaatcccgtccaccgattgactaaggtttccagaggaaggctcgtccgctctgggttagtcgggtccctaaacctgaggccgcaanngtagg

SEQ ID NO: 4517 - DNA, 319 bp; double-stranded, linear
ttgaatctgacgaaacgagaaaagagcgcaacgagtttagtagagctaaatgagtaagcgagagccgaagagaggaaagaagcaagcgattgtcacaagtcaagaaaggtctttagcgacgatggtagccaacttacgttccgctagagtagaacgttgccaggcaaaaaatgggatgcgatgagccgcattggagaccgcagtcctntntntttttttatggccttaaaacgtcaaaattaaaaagttaaacacaaagaaaatgggctttggcgagtggaaacgttttgaatctggacggaacgagaaagagcgcacg

SEQ ID NO: 4518 - DNA, 259 bp; double-stranded, linear
ggtataatagatgactatgtactatttccggtacatccttggcaatatcagcatattctgccgaacgtctttgcgaaagagattagtgaaaagttggttgtactattaccgttaaaatttggagattatctgtcgtcttcaagtatgcgttcattaattgatattggcgcaccgtataaccatgtcaangtaccatttgcaatgcagtcattaggcgcattaaggctaacgnctacggttacatgaaaaacggggaaca

SEQ ID NO: 4519 - DNA, 253 bp; double-stranded, linear
atagggtgttgctgaatagggcgtttagtatttggtcgtaccgnnaaccaggtgatctacccttggtcaggttgaagttcaggtaacactgaatggaggaccgaaccgacttacgttgaaaagtgagcggatgaactgagggtagcggagaaattccaatcgaacctgggagatagctggttctctccgaaatagctttagggctagcctcaagtgatgattattggaggtagagcactgtttggacgagggg

SEQ ID NO: 4520 - DNA, 245 bp; double-stranded, linear
aactcgttgcgctcttttctcgtttcgtcagattcaaacgttttcacttcgccaagccatttttctttgtgtttactttttattttgacgttttagacataaaaaaagagacctcacggtctcaacttgcctggcaacgttctactctagcggaacgtaagttggcnaccatcgtcgctaaagacctttcttgactngtgacaatcgcttgcttctgtcctctccttcggctctcgcttactcat

SEQ ID NO: 4521 - DNA, 251 bp; double-stranded, linear
gggcctaagtggactcgaaccaccgacctcacgcttatcaggcgtgcgctctaaccagctgagctataggcccattaatttgaatgaacaaacattcaaaactgaatacaatatgtcacgttattccgcatcttctgaagaagatgttccgaatatatccttagaaaggaggtgatccagccgcaccttccgatacggctaccttgttacgacttcaccccaatcatttgtncccaccttncgacggctag

SEQ ID NO: 4522 - DNA, 249 bp; double-stranded, linear
natagaacctgaaaccgtgtgcttacaagtagtcagagcccgttaatggttgatggcgtgccttttgtagaatgaaccggcgagttacgatttgatgcaaggttaagcagtaaatgtggagccgtagcgaaacgatgtctgaatagggcgtttagtatttggtcgtagaccgaaacctggtgatctacccttggtcangttgaagttcaggtaacactgaatggaggaccgaaccgacttacgtttgaa

SEQ ID NO: 4523 - DNA, 248 bp; double-stranded, linear
tccctatccgtcgtgggcgtaggaaatttgagaggagctgtccttagtacgagaggaccgggatggacatacctctggtgtaccaattgtcgtgccaangcatagctgggtagctatgtgtggacgggataagtgctgaagatctnaagcatgaagcccccctcaagatgagatttcccacttcggttataagatccctcaaagatgatgaggttaataggttcgaggtggaagcatggtgacagtgg

SEQ ID NO: 4524 - DNA, 326 bp; double-stranded, linear
aacgttaagatccctattaaattatcttaggaatcatcatgggcatttatgatgtcttaaagctggatatcgacatacttatatatggttacggtgtcccatggcttacatatttttataaaattagtaatctgaatctgcttctaaaccttgtcataatttgancggctgtggctcgnaccaatacgggtcggacctgcttnaaccattttattggaaatcttctaaattacggacggcacccggatgcttttacttctatatcagcacctactgtatctttcattaatttaacggcttctgcagtcggaccggcaactgcaaaa

SEQ ID NO: 4525 - DNA, 301 bp; double-stranded, linear
aagagcacccttctccgagttacggggtcatttgccggttccttaacgagagtcgctcgtcaccttagattctcatcttgactaccttgtcggtttgcggtanggcacctattttctatctagaggttttctcggcatgtgaaatcaacgactcgagacacaatgtcttctcccatcacagtcagccttaacgagtaccggatttgcctaatactcagcctactgcttagnggcatccatcgcagttngctatccactggtccccctcgattaaacgattataggtggtacagatatcaac

SEQ ID NO: 4526 - DNA, 241 bp; double-stranded, linear
tgatattatgagctgtgtttttagctttagaaccgaagtcccctgcttttttaccaagattttcagtaacttgtnccatccattttttctttttcgtaccaccatggaattttggcaaaacacccatccgctgtaacttcagagtgtcattggcatttattacactatctccaactcctagtggaacaaccacatctcgtccttggggtgcatggaatgtnccgtcagccctgtgaattat

SEQ ID NO: 4527 - DNA, 316 bp; double-stranded, linear
cgatcacactcttccgtcgtcatcgccattggcttttcacacaatacatggacaccatggtgtcaatgcttctatagaaagatcagcatggaatttattaggtgtacaaatgaccaccgcatcaacaagtttaaacagctcgctaggtgtctcaactgcatgaggtatattgaaagcgcttcgcaaccatncaatcatctggcactgttattgaatatcttgtgactggcaacttaatgagnactgtgtcttttggagtttccagncaatgccgggaattatggacgggtcttggtggcaataccacccaacacct

SEQ ID NO: 4528 - DNA, 251 bp; double-stranded, linear
gtcccaagggttgggctgttcgcccattaaagcggtaccgacgactgggttcagaacgtcgtgagacagttcggtccctatccgtcgtgggcgtagaaatttgagaggagctgtccttagtacgaggaggancgggatggacatacctctggtgnaccagttgtcgtgccaacggcatagctgggtagctatgtgtggacgggataagtgctgaaagcatctaagcatgaagcccccctcaagatgagatt

SEQ ID NO: 4529 - DNA, 318 bp; double-stranded, linear
agtacgtgacgttcactactctcactatggccgtatgtgtccaattgaaacacctgagggaccaaacattggattgattaactcattatcaagttatgcacgtgtaaatgaattcggctttattgaaacaccatatcgtaaagttgatttaggatacacatgctatcactgatcaaatgactattaacagctgacgagaagatagctatgttgtagcacaagcaaactctaatagatgaaatggtcgttcaggtgatgagtgtatgcgttcgggnacnatcagtatgcaagaaaaggtttgtgacgcgacagtgtcna

SEQ ID NO: 4530 - DNA, 240 bp; double-stranded, linear
tagctgtgtgataaattgcaagtgcggcaccacataagccgaacatcatcgtaataaaacggcctgacatacagcgtgacacacctgaataatacttcgtcacatctggatcaccaagttgagcaaagangatgttctncgtaccttgaactaagtgccctttgacttctaaagtaccaccaagtgccgtctgccaaaacggtaagtaaaaaatatggtgtaaaccgagtggacctaaca

SEQ ID NO: 4531 - DNA, 254 bp; double-stranded, linear
cggctcttctgggacgttaaccctaaagtgcaccccttctcccgaattacggggtcattttgccgagttccttaacgagattcgactcgntcaccttagaattctcatcttgactacctgtgatcggtttgcggttaggggcacctattttctatctagaggcttttctcggcagtgtgaaatcaacgactcgaagacacaatgtcttctccccatcacagcncagccttaacgagtaccggatttgcctaata

SEQ ID NO: 4532 - DNA, 238 bp; double-stranded, linear
cattacgtataaatggcaatcgtgatactacaggtacaaatgacgcaaactggtcagctatgaataaaccgaatgtggctaaagtcgttaacgcaaaatatgacgtcatctataacggacatacttttgcaacatctttaccagcgnaatttgtagtaaaagatgtgcaaccagcganaccaactgtgactgaaacagcggcaggagcgattacaattgcacctggagcaaaccaaac

SEQ ID NO: 4533 - DNA, 266 bp; double-stranded, linear
ggtcattaataaaatatctaaagccattactgcataaaaatctcatcaagccaatacctacattgtactactggncactttagacaggncaagggtgtagctaccgataattcaggagcattaacgcaaccgacatttgactgtattaaatgatagaggttctggaaaacgccccaggtggtggagttcaagaaataattcacagggctgacggaacattcctgcaccccaaggacgagatgtggttgttccactaggagttggaa

SEQ ID NO: 4534 - DNA, 264 bp; double-stranded, linear
tactcagaggataccccgacgtaatgcattcaattcaatttttaaacgtattatttcattgagcagaaagaaaattatggcaccaaactttaatatttttttcaatgtcattcttttgangggagtgggacagaaatgatattttcgcaaaatttatttcgtcgtcccaccccaacttggcattgtctgtagaaattgggaatccaatttctctttgtnggggcccatccccaacttgcacattattgtaagctgacttttcgt

SEQ ID NO: 4535 - DNA, 250 bp; double-stranded, linear
gcgaatggataacagttgatattcctgtaccacctgataaatcgttttaatcgatggggggacgcataggnataggcgactgccgattggattgcactctaagcagtaaggctgagtattaggcaaatccggtactcgttaaggctgagctgtgatggggagaagacattgtgtcttcgagtcgttgatttcacactgccgagaaaagcctctagatagaaaataggtgccccgtacngcaaaccgacac

SEQ ID NO: 4536 - DNA, 235 bp; double-stranded, linear
aatgacgggttcgaaccgccgaccctctgcttgtaaggcagatgctctcccagctgagctaattctccgatttaaaactgcctggcaacgttctactctagcggaantaattcgaactaccatcgacgctaaggagcttaacttctgtgttcggcatgggaacaggtgtgacctccttgctatagtcaccagacatatgaatgtaatttatacattcaaaactanatagtaagta

SEQ ID NO: 4537 - DNA, 234 bp; double-stranded, linear
tgcatcttcacaggtactatgatttcaccgagtctctcgttgagacagtgcccaaatcgttacgcctttcgtgcgggtcggaacttacccgacaaggaatttcgctaccttaggaccgttatagttacggccgccgtttactggggcttcgattcgtagcttcgcagaagctaaccactcctcttaaccttccagcaccgggcaggcgtcagccctatacatcaccttacggtt

SEQ ID NO: 4538 - DNA, 242 bp; double-stranded, linear
accctctgcttgtnaggcagatgctctcccagctgagctaattctccgatttaaaactgcctggcaacgttctactctagcggaacgtaagtngactaccatcgacgctaaggagcttaacttctgtgttcggcatgggaacaggtgtgacctccttgctatagtcaccagacatatgaatgtaatttatacattcaaaactagatagtaagtaaaagtgattttgcttcgcaaaccattta

SEQ ID NO: 4539 - DNA, 234 bp; double-stranded, linear
tcattaacaccatcaccataaataaaaccttccatatctgttcctgtgccaataaagccatattgcgtttggnctgtcgtgccagtgcaagatttccaacgataatttctaggcgtcactgctggcgaaccatctaatggataatcataatccatcgtgcgtccaagaagtacttgntttatttaaagtttgtattgtggaatcctgtgcacatgttctcactcctctgtacct

SEQ ID NO: 4540 - DNA, 242 bp; double-stranded, linear
acacaaagaaaaatggcttggcgaagtgaaaacngttgaatctgacgaaacgagaaaagagcgcaacgagtttagtagagctaaatgagtaagcgagaccgaagagaggaaagaagcnagcgattgtcacaagtcaagaaaggttcttagcgaggatggtagctaacttacgttccgctagagtagaacgttgctagacaagaaatgaatgcgatgagccgcattgagtgtgaaattgatat

SEQ ID NO: 4541 - DNA, 240 bp; double-stranded, linear
gcccttaataacttaatctatgtttccaccatttttataagtcaaacgctcacatacggcttcgttttcattattttaaatgctcatttacataagtaaactctgctttaaaataatttaactcattgtctgctaaacgttttcttttataaaaagatttaaacgcgttattaatcttgtgnagtgttctttcgaacataggcgattatntcttatgaattcaagcttatttaaaactct

SEQ ID NO: 4542 - DNA, 242 bp; double-stranded, linear
aagctagcaatgatgtcaagcaatggcaacatgtgctcanttagctaatatgcaagcacatggtgaatatgacgaggttgcaacttcaacggcgaggntgatgaatgccttacgtttgcgtgagacagtagctatgggccgcggtattacaggtggtaatggcatactgagctgacgattatgatattgtcacgttttcttctctgtatgcagaagcgatttacacgtacgaggtacacatg

SEQ ID NO: 4543 - DNA, 239 bp; double-stranded, linear
tggtgagccatagaggattcgaacctctgaccctctgattaaaagtcagatgctctaccaactgagctaatggctcttccatggtgccggccagaggacttgaacccccaacctactgattacaagtcagttgctctaccaattgagctaggccggcaatatgtaagattaaatggtggagantgacgggttcgaaccgccgaccctctgcttgtaaggcagatgctctnccagctgag

SEQ ID NO: 4544 - DNA, 239 bp; double-stranded, linear
atagaggattcgaacctctgaccctctgattaaaagtcagatgctctaccaactgagctaatggctcttccatggtgccggccagaggacttgaacccccaacctactgattacaagtcagttgctctaccaattgagctaggccggcaatatgtaagaataaatggtggagaatgacgggttcgaaccgncgaccctctgcttgtaaggcagatgctctnccagctgagctaaattct

SEQ ID NO: 4545 - DNA, 233 bp; double-stranded, linear
aattcatgctttcaaaagacgatatactacgacactcctacgaacttgtccaaggattacgaaaagacctaaggttatgtaattggcctaaatttattaatcgtttaaattcagttagtaaaaagtctgtgagtaagggtgtatggaaagtggttanatattatagaaaacatcaaaggatgttaagaaatacnatttattacccagcatttaataatggtgctatagaagga

SEQ ID NO: 4546 - DNA, 247 bp; double-stranded, linear
actttgttgtcttccatcaacttgagacttcataacgttttgcatcttcgccaccttcaccactattactctttccacctaattggttcatggcttgtgctantttttcatgtgcttccgctgaaatcgatccataactcatcgcccctgtattaaagcgtttgacaatgtcacttaccggttcaacttggncgatgtcaatcggtgtacatgctttaaattcaagtaaatgtctaatgtgatctgt

SEQ ID NO: 4547 - DNA, 300 bp; double-stranded, linear
gaggaaattactgaaaacaatcatcatatttctcattctggtttaggaactgaaaatggtcacggtaattatggcgtgattgaagaaatcgaagaaaatagccacgtggatattaagagtgaattaggttacgaaggtggccaaaatagcggtaatccagtgcatttgaggaagacacagaagaagtttaaaccgaaatatgnaaccaaggtgggcattatcgttggttatcgattttcgatagtgtacctcaaatttcatgggtccaaattaatggttaacccatccattcgangnagg

SEQ ID NO: 4548 - DNA, 306 bp; double-stranded, linear
ttgctatagtcaccagacatatgaatgtaaattatacattcaaaactagatagtaagtcaaagtgattttgcttcgcaaacatttattttgattaagtcttcgatcgattagtattcgtcagctccacatgtcaccatgcttccacctcgaacctattaacctcatcatctttgaggggatcttgataaaccgnaagttggggaaatctcatctttacgggggggcttcatgcttaggatggctttncagcactttatgcccggtnccacacattaggcttacccagcctatgcccgtttggcacg

SEQ ID NO: 4549 - DNA, 232 bp; double-stranded, linear
atttcgattcgtgattttgaatacttttcttccacacaaatgtatacctattggcattagcttctacttttgtaccatcaataagattttgctttaaacattgactatgaaactggataaataaagattcaattaacgcatcagtattaggattcactctaatacgattaatagttttataagaaggtgnttgattttgagctaaccacatcattcgaatactgtcatgnag

SEQ ID NO: 4550 - DNA, 258 bp; double-stranded, linear
ctgggttcagaacgtcgtatgnagttcggatccctatccgtcgtgggcgtaggaaatttgagaggagctgtccttagtacgagaggaccgggatggacatacctctggtgtaccagttgtcgtgccaangcataagctgggtagctatgtgtggacgggataagtgctgaaacattcttaagcatgaagcccccctcaagatgagatttcccaacttcggttataagatccctcaaagatgatgaagttaataagttc

SEQ ID NO: 4551 - DNA, 400 bp; double-stranded, linear
ttacaggcatgcgagttggggtgagggcccacacagaagctgacgaaaagtcatgacaataatgtgcaagttggggatgggcccacaaagagaaattggattcccaattttacagacaatgcaagttgggtgggacgacgaaataaatttgcgaaaatatcatttctgtnccctccctcaaaagatgacattgaaaaaatattaaagttggtgccatattttcttctgctcatgaatatacgttaaaattgattgatcatcgcgaattgatattattctcattataaaaatacttattacacttaccgtatgatagtttgntatatactctgataaagtcaaacctaatagcgtttctagctgtgngtgtttcataattatatacattatcaggctttaa

SEQ ID NO: 4552 - DNA, 312 bp; double-stranded, linear
ataggaaactgccaattggacggttgccgcattcaaacccagcacgattacggcgaattgcacgtgaancatttctacagcttgatcttgacctatgattttacttcttaaacgattagaaatattttttaaacgttcaatatcgttatcatccatttggagaaactgggaataccattgaatcgttgnaatagtatctggaaatatcatggaactgtagcaacagcagtgtgttgcaccattnactgattttgctaatttatcttggtgaatggatttggatttgcattttggaatgtgcgtgcagctttt

SEQ ID NO: 4553 - DNA, 254 bp; double-stranded, linear
agcagcgatcaaaaataatccgcaatacgctggcaaactaccaataccaaaccatagaacaacaaatggtgcccatgctatcggagatatcggcctaatcaattgaaatagcggttcgatagcgttgtatagccaacgattccttccaagcaagaagcccaatggaatagcaaccaacaatgcgacaacaaagnccgctacaaatctccatgaactaattgctaaatgtggngaatttctccagtaacaatgga

SEQ ID NO: 4554 - DNA, 251 bp; double-stranded, linear
ggtctgaatcgctatctgagtctgaatcgctatctgagtctgaatcactgtctgagtccnagtcactgtctgaatctgactcactatctgattctgagtcgctatctgattctgagtcgctgtctggaatctgaatcactgtctggaatccgaatcgctatctggatctgagtcgctatctgaacccgagtcgctgtctgagcctgagtcactgtctgaaatcgaaatcggaacccgggnctggggcttgg

SEQ ID NO: 4555 - DNA, 251 bp; double-stranded, linear
tacacaaagagataaattacttatgcaaaggcggaggaatcacatgtctattactgaaaaacaacgtcagcaacaagctgaattacataaaaaattatggtcgattgcgaatgatttaagagggaacatggatgcgagtgaattccgtaattacattttaggcttgatttctatcgcttcctatctgaaaaagcccnaccagaatatgcagtgccctgtcaagngaagacatcacgttccagaagcatggc

SEQ ID NO: 4556 - DNA, 243 bp; double-stranded, linear
agctaccccggggataacaggcttatctcccccaaganttcgcatcgacggggaggtttggcacctcgatgtcggctcatcgcatcctggggctgtagtcggtcccaagggttgggctgttcgcccattaaagcggtacggaggctgggttccgaacgtcgtgagnccgttcggtccctatccgtcgtgggcgtaggaatttgagaggagctgtccttagtacgagaggaccgggtggacata

SEQ ID NO: 4557 - DNA, 235 bp; double-stranded, linear
taacttaatctatgtttccaccatttttataagtcaaacgctcnggggggggcttcgttttcattattttaaatgctcatttacataagtaaactctgctttaaaataatttaactcattgtctgctaaacgttttcttttataaaaagatttaaacgcgttattaatcttgtgagtgttctttcgaacactagncgattatttcttatgaattcaagcttatttaaaactcttg

SEQ ID NO: 4558 - DNA, 275 bp; double-stranded, linear
ccgttaagcactaaatccgcttaataacggctttctatcgcgcgcaacatctcgtttgactgctttttctttcaaagcttgacgttatcatattttttcttacctcgtgcacaccaagtaatactttacaatgtccatgcttcaaataaagctttaacggacaatcgaataaccaanctcacgtgtttgatcacccaatttaatgatttcacgcttgtgcaataatnattttcgagacgagaggatcggattaaaacgatcccctcctcgtatgg

SEQ ID NO: 4559 - DNA, 234 bp; double-stranded, linear
ttatatggatgtatcgccgaagcaagttgtttcagcagcgacanatgtattccgatgactcaaaccgtgcattgatgggtgcgaacatgcaacgtcaagcagtgcctttggatgaatccagaagcaccatttgttggtacaggtatggaacacgttgcagcacgtgtattctgngtgcggctattacagctaaagcacagaggtcgtgttgaacatgttggaatctaatgaaat

SEQ ID NO: 4560 - DNA, 232 bp; double-stranded, linear
ttattttgacgttttagacataaaaaaagagacctcacggtctcaacttgcctggcaacgttctactctagcggaantaantggctaccatcgtcgctaaagacctttcttgacttgtgacaatcgcttgcttctttcctctccttcggctctcgcttactcatttagctctactaaactcgttgcgctcttttctcgtttcgtcagattcaaacgttttcacttcgccaag

SEQ ID NO: 4561 - DNA, 257 bp; double-stranded, linear
tcaaaggacgcataccattacgggtctgctacttgtaagcacacggtttcaggttctatttcactccccttccggggtgcttttnacctttccctcacggtactggttcactatcggtcactagagagtatttagccttaggagatggtcctcccagattccgacggaatttcacgtgctccgtcgtactcaggatccantcaagagagacaacattttcgactacaggattattaccttctttgattcatcttgtc

SEQ ID NO: 4562 - DNA, 240 bp; double-stranded, linear
tacctaataagttgtgaatttgaacagcggctgctttacantggaactgctgattcagttgccacaattaccataccaattttctttttgtcttcgtctgtnataatgtccttagcagcgttagctccgattgaaacgatgtcttggtttacaggactaacagccatttcagtttgaccaattccaattaaaaatttgtttgggtctacttggcgtggcttcctgctgaatttagccatg

SEQ ID NO: 4563 - DNA, 225 bp; double-stranded, linear
caaagcttacttacagctccccaaagcatatcgtcgttagtaacgtccttcatcggcttctagtgccaaggcatccaccgtgcgcccttaataacttaatctatgtttccaccatttttataagtcaaacgctcacatacggcttcgttttcattattttanatgctcatttacataagtngactctgctttaaaataatttaactcattgtctgctaaacgttt

SEQ ID NO: 4564 - DNA, 233 bp; double-stranded, linear
tgttaattggngaatttggatactggttatattcagctgcaccgcaagcaacttctattgatggcctaactgcctttttacctcaagcaatgggtatggtaattgttgcagtcatttatggctttatgaatatgaaagcagaggaatcccattcccgtaataaaattacggtggttacaaaattatttcaggtttctttcttttgcatttgggtgctttaaccatatcttntt

SEQ ID NO: 4565 - DNA, 225 bp; double-stranded, linear
agctcagatagcgctcagactcagacagcgactcagattcagatagcgattcagactcagacagcgactcagactcagacagcgactcagactcagatagcgactcagattcagatagcgattcagactcagacagcgactcagattcagatngcgattcggantcagacagcgattcagattcagacagcgactcagactcggatagcgattcagattcagata

SEQ ID NO: 4566 - DNA, 237 bp; double-stranded, linear
ccaactggagctaatggctcttccatggtgccggccagaggacttgaacccccaacctactgattacaagtcagttgctctaccaattgagctaggccggcaatatgtaagaataaatggtggagantgacgggttcgaaccgccgancctctgcttgtgaaggcagatgctctcccagctgagctaattctccgatttaaaactggcctgggcaacgttctactctagcgggaact

SEQ ID NO: 4567 - DNA, 300 bp; double-stranded, linear
gttggagatagtgtaataatgccaatgagccactctgaagttacagcggatgggtgttttgccaaaattccatggtggtacgaaaaagaaaaaatggatggaaacaagttactgaaaatcttggtaaaaaagcaggggacttcggttctaaagctaaaacacagctcataatatcaaaaaggtgcagaggaaatggttgannggcagcggataaatcaagatggtgcacttggttagcgttaaatcgcgatgtgtgggttantacacatccgggaactagtaataagtatgtcagtttaa

SEQ ID NO: 4568 - DNA, 250 bp; double-stranded, linear
atcccgtggaggttcaagtcctctcggccgcatcaaaattcttaatttaaataagcgggtgtagtttaatggcaaaacctcagccttccaagctgatgttgtgggttcgattcccatcacccgctccatagataattttaatgaacattgaaaactgaatgacaatatgtcaacgttaattccaaaaacgtaactataagttacaaacattnattttagtatttgatggagcctnaatccaaacattcca

SEQ ID NO: 4569 - DNA, 235 bp; double-stranded, linear
gatcccctagctttacgttcaactttatatgggtataactcgaatataatttggcgctctatgtcatgggacaacgagtagacatttaataacggatcaggttctggtgacggtatcgataaaccagttgttcctgaacaacctggtgagcctggtgaaattgaaccaattccagaggnttcagattctgacccaggttcagattctgggcagcgnttctaattcagatagcggt

SEQ ID NO: 4570 - DNA, 223 bp; double-stranded, linear
aatctatttcttctattgttaaatcgctatctccatcttcttttatctctggtattattttttcttcaactaagtcacgatataatgtttttgaattttcgttcaatttcgattcgtgattttgaatacttttcttccacacaaatgtatacctattggcattagcntctacttttgtaccancaataagattttgctttaaacattgactatgaaactggga

SEQ ID NO: 4571 - DNA, 267 bp; double-stranded, linear
catgatattttgaaccgcatggttaaagttgcaaagacggtcttgctgtcacttatagatggatccgcgctgcattagctagttcgtaaggtaacggcttaccaaggcaacgatgcatagccgaccttagagggtgatcggccacactggnactaagacacggtccagactcctacgggaggcagcagtagggaattttccgcaatgggcgaaagctgtacggcgcaacgtcgtgtgnagtgctgcaggttcttcggatcgtaaaat

SEQ ID NO: 4572 - DNA, 221 bp; double-stranded, linear
aatncaacttttacttactatctagttttgaatgtataaattacattcatatgtctggtgactatagcaaggnggtcacacctgttcccatgccgaacacagaagttaagctccttagcgtcgatggtagtcgaacttacgttccgctagagtagaacgttgccaggcataatattaatccacagtagctcagtggtagagctatcggctgttaaccgatc

SEQ ID NO: 4573 - DNA, 230 bp; double-stranded, linear
gcagaaatgccagccgcattgagtgaacacagagttacagggtattctgtagccgaaccattcggtgcantgggggaaaagttaggcaaaggtaagactttgaaacatggtgatgacgttatacctgatgcgtattgctgtgtgctagtactnagaggggaattgcttgatcaacacaaggatgtagcgcaagatttgtacaaggttataaaaagtctggctttaaaatg

SEQ ID NO: 4574 - DNA, 230 bp; double-stranded, linear
tcacatatcgataacatgacataactcatgctgggtttccccattcggaaatctctggatcaaagcttacttacagctccccaaagcatatcgtcgttagtaacgtccttcatcggcttctagtgccaaggcatccaccgtgcgcccttaataacttaatcnatgtttccaccatttttataagtcaaacgctcacatacggcttcgttttcattantttaaatggctca

SEQ ID NO: 4575 - DNA, 309 bp; double-stranded, linear
cttacaatagtgtgcaagttggggtggagccccgacacagagaaattagctcctcaatttctacagacaatgcaagttggcggggccccaacacagaagctggcgaaaagtcagcttacaatagtgtgcaagttggggtgggacgacgaaataaattttgcgaaaatatcatttctgtcccactcccaaaaagaccgcagtaggataattccatttggaaataccttactgccngtttttaaagtaatagcnaatattttggaattangtttcctagttaaccataccaactaatggcctccttaaatt

SEQ ID NO: 4576 - DNA, 240 bp; double-stranded, linear
tgattctaggaattcaagcttatttaaaactctttattcactcggttttgcttgggtaaaatctatattttacttacttatctagttttcaatgtacaaataatggtgggcctaagtggactcgaaccaccgacctcacgcttatcaggcgtgcgctctaaccagctgagctataggcccatttttttgaatgttaaataaacatcnaaactggnataccatatgtcacggtaatccgca

SEQ ID NO: 4577 - DNA, 233 bp; double-stranded, linear
cttcgtgttaaaatttgatgcacaatggtcatcatttttatctttccaataagtactgtctgggtaaaaatntattaattgggtggttcgtgaaatgcaatctttttaacgacttcagggtaatcttttaacacatgcatcgcaacgattgaacctnaacttgaacctaatatatagacaggttcatcacttaatgactttgcaagttcggcaatgtcctgtgcgtcgcgttt

SEQ ID NO: 4578 - DNA, 324 bp; double-stranded, linear
taggcataccaaagtcgataccatagtgacgaccgccattaaagttaagtccacctgtgtaactcccaaacctttgccaaattggatggtcaaatagatagcttccatcgcctccgccaccaaaatcttcaaaccacgatttactttgnctactaatttctttttgagcaatgagtacgcgccttagcaattttangtagcgtagtccgctccaaaataatattaaactgacatacttattacnagttccctggatgtgtacataatccacacatcgcgatttatcgctaacagagcacacttgattacgcgcgctcaacattc

SEQ ID NO: 4579 - DNA, 229 bp; double-stranded, linear
aatgtaaaaactgatttctattaattatttgatagaaatcacttttttgtattttataatgtacagctcgttgcattcatatagcttgaagtcacgtttaaaaccatatctatcattatggtatgcatatcgtttaaaacctattcttttgttantaggacatataaattcatcattaattcgtcatatttccaattttgagtgtnaaaaatgtcacttttaaactttc

SEQ ID NO: 4580 - DNA, 239 bp; double-stranded, linear
cggggactcnaacccgtgttgaccgccgtggaaagggcggtgtcttaaccgcttgnaccaaggagccatggctccacaggtaggactcgaacctacgaccgatcggttaacagccgatagctctaccactgagctactgtggattaatattatgcctggcaacgttctactctagcggaacgtaagttcgactaccatcgacgctaaggagcttaacttctgtgttcggcatgggaaca

SEQ ID NO: 4581 - DNA, 233 bp; double-stranded, linear
ccgnacgaatttacacgtgttccgtcgtactcaggatccactcaagagagacaacattttcgactacaggattattaccttctttgattcatctttccagatgattcgtctaatgtcgtcctttgtaactccgtatagagtgtcctacaaccccaacaagcaagcttgttgtnttgggctcttcccgtttcgctcgccgctactaagggaatcgaattttctttctcttcctc

SEQ ID NO: 4582 - DNA, 218 bp; double-stranded, linear
ttagtaaaaagtctgtgagtaagggtgtatggaaagtggttaaatattatagaaaacatcaaaggatgttaagaaatacaatttattacccagcatttaataatggtgctatagaaggaattaataataagataaaattaatcaagtgaatttcttttggttacagaaatttcancanctttaaagcacgtataatgatggattttcagcttgtacaa

SEQ ID NO: 4583 - DNA, 251 bp; double-stranded, linear
taataaacatgccatacgtaataagtggcgttgtattaaaatcatctataatagccatatagttttgctcactaccataacctgcatcagctacaatatactccggtaaataaccgatggattttggaatcattgttaaaaatggaattaaagttctagtgatctgttgggttttggaaataggtcatagggtnaaaacntttttgagaatttgtcgctatttgttaaattgtatcccggcttgaagttgg

SEQ ID NO: 4584 - DNA, 229 bp; double-stranded, linear
tttaggaccgttatagttacggccgccgtttactggggcttcgattcgtagcttcgcagantaacccactcctcttaaccttccagcaccggggcaggcgtcacccctatacatcaccttacggttagcagagactgtgtttttgataaacagtcgctnggcctattcaatgggggctcttctgggggttaaacctaaagagcaacccttctcccgaagttacggggtc

SEQ ID NO: 4585 - DNA, 218 bp; double-stranded, linear
ttataaaaagatttaaacgcgttattaatcttgtgagtgttctttcgaacatagcgattatttcttatgaattcaagcttatttaaaactctttattcactcggttttgcttggtaaaatctatatttacttacttatctagttttcaatgtacaattnctttttagtcaagcgctcgcatactgctntattttcaaaaaatcaaatgctcatttaca

SEQ ID NO: 4586 - DNA, 241 bp; double-stranded, linear
gggggggggccttcgccactggtgttcctccatatctctgcgcatttcaccgctacacatggaattccactttcctcttctgcactcaagttttccagtttccaatgaccctccacggttganccggggcttttcacatcagacttaaaaaaccgcctacgcgcgcttgtacgcccaataattccggataacgcttgccacctacgtatttaccgcgggctgctggcacgtattnagccgt

SEQ ID NO: 4587 - DNA, 253 bp; double-stranded, linear
cagccacctgttgccaccagctacacttgcattgtttgctacgacacgcccaaacaatgctgaagtgaataagaaatcaatcatttgctcttctgttaaatcatgtgttttttctaatttaaaaagtgcaccgggaatggtacccgaggaaccagctgttggcgttgcacaaataatacccatcgcagcattgacttcattgttgcaaggcaccnttgactgcggcaatcattcatatccgacnaagcagatg

SEQ ID NO: 4588 - DNA, 218 bp; double-stranded, linear
atgaacgggtggtagcgagtggacgaaaaacatcaatgaaaagctagctgtagttgcaagagaaactggcttacgatggcattggatcaacacatgcggcattgagaaatccacgcatggctgagacgtttacgattgcgcgaaaaatgaatcctgaaggcattttagcaatgttggtgcggacgtaccagtagaaaaggctttggaagcagttgaat

SEQ ID NO: 4589 - DNA, 216 bp; double-stranded, linear
gccatggctccacaggtaggactcgaacctacgaccgatcggttaacagccgatagctctaccactgagctactgtggattaatattatgcctggcaacgttctactctancggaacgtaagttcgactaccatcgacgctaaggagcttaacttctgtgttcggcatgggaacaggtgtgacctccttgctatagtcaccagacatatgnatgta

SEQ ID NO: 4590 - DNA, 234 bp; double-stranded, linear
agatttaaataatcaaaagtgcacattattaaaatatcaatttcacactcaatgcggctcatcncattcatttcttgtctagcaacgttctactctagcggaacgtaagttagctaccatcctcggctaagaacctttcttgacttgtgacaatcggcttgcttctttcctctccttcggctctcgctactcaatttagctctactaaactcggttgcggctcttttctngttt

SEQ ID NO: 4591 - DNA, 216 bp; double-stranded, linear
aattgactgacttcgttttaccgcgtgtttaatattgttatacatatattctaattgcacatttaaacttcgtaaatgccaatgtgngtgggacagaaatgatattttcgcaaaatttatttcgtcgtcccaccccaacttgncacattattgtaacctgactttccgccagcttctatgttggggccccgccaacttgcacattattgtaagctg

SEQ ID NO: 4592 - DNA, 216 bp; double-stranded, linear
attccggataacgcttgccacctacgtattaccgcggctgctggcacgtnttagccgtggctttctgattaggtaccgtcaagatgtgcacagttacttacacatatgttcttccctaataacagagttttacgatccgaagaccttcatcactcacgcggcgntgctccgtcaggctttcgccattgcggaagattccctactgctgcctccccg

SEQ ID NO: 4593 - DNA, 228 bp; double-stranded, linear
ttggactagaaccaatgaaggacgttactaacgacgatatgcttaaaggagctgtaagtaagctttgatccagagatttccgaatggggaaacccagcatgagttatgtcatgttatcgatatgtgaatacatagcatatcaganggcacacccggagaactgaaacatcttagtacccngtggaagagaaagaaaattcgattcccttagtagcggcgagcagaacg

SEQ ID NO: 4594 - DNA, 252 bp; double-stranded, linear
caatcgttgaaggaaatgtaccagcagcaatcaaagacaaagaaattatttctgtagacatttcatcattagaagctggaacgcaatatcgtggtgcttttgaagaaaatattcaaaaattaatcgaaggtgttaaatcttcacaaaatgccgtactattctttgatgaaatccatcaaattatcggttcaggtgccacagnaagtggattccaggttagccaaaggggttaatctggattaattttttttn

SEQ ID NO: 4595 - DNA, 258 bp; double-stranded, linear
actctctagtgaccgatagtgaaccagtaccgtgaggagaaggtgaaaagcaccccggaaggagntgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcagaagcacggttctggaataggggcgttttagttattttgggtcgttacccgggagnaaagg

SEQ ID NO: 4596 - DNA, 229 bp; double-stranded, linear
cctaccgctgcagccgctggatctgctggagttgcattaggatctgccggtgccgcacgtctacttctctttttcggtctattagatgctggttcagcaattgcaactagctctggtttatttgaagaatgacgaacatcttcttgaatttcctttaaagtagatgtcctcctgaaccattncattgtttagttgggtacattaatgcngtattatcgacactacatca

SEQ ID NO: 4597 - DNA, 246 bp; double-stranded, linear
gctcaccttagaattctcatcttgcactcacctggtggtcggtttggcgggtagggtcacctattttctatctagcaggcttttctcggcagtgtgaaatcaacgactcgaagncacaatggtcttctccccatcacagctcagccttaacgagtaccggatttgcctaatactcagccttactgcttagacgtgcaatccaatcgcacgcttcgcctatcctactgnggtccccccatcgattaa

SEQ ID NO: 4598 - DNA, 223 bp; double-stranded, linear
aagaaaataaagaatgctacaattacgattgcaatcaaaccaaagaaccataatgatgtgtaccaagtgctgcacctttagtaatgacaacgtttaaacttagcaacataactactagaacaattagccctgcaacgtcaaatttatgtgtattggtaatttctgatttcgtttcaggcgtccctttgatgagtagcattgaaagtacggnaacgatgngttg

SEQ ID NO: 4599 - DNA, 219 bp; double-stranded, linear
ntntcactgtttgacccggtaccgtgtcagataatcccgcacgcaatgcaatcgttcgtgcaatgttttggccttgtaatccttctggaaaagccgtaccaacaatgacatcttcaatcatattcttattgaattttccgtcaatacgtttcaatacgccttgtaatactttggctgcgacatcatcaggtctttcgtggaataatgcgcctgctttgc

SEQ ID NO: 4600 - DNA, 208 bp; double-stranded, linear
aaggttaagaggagtggttagcttctgcgaataccgaatcgaakccccagtaaacggcggccgtaactataacggtcctaaggtagcgaaattccttgtcgggtaagttccgacccgcacgaaaggcgtaacgatttgggcactgtctcaacgagagactcggtgaaaatcatagtacctgtgaagatgcaggttacccgcggacagg

SEQ ID NO: 4601 - DNA, 286 bp; double-stranded, linear
agtgccagtgattaactgcatttttcaatagatcagggaagactaccaagcttatgttgaaggacatcttttggcgttaccggttgggcaggtatgttgtattaccgttcacaacagcatcacttgaacaacatttgttaacggattatttggcaattcgttattgtcgaacantgcnagttggtgagatttaatcatcgctaaagatgtgaaatagatcgaaaatggtttaagcaaacgttgctcaggtgttactacgtgatatgcctagcgagtatactacaac

SEQ ID NO: 4602 - DNA, 264 bp; double-stranded, linear
atatggctatggtattcacatatcgatnaacatggacataactcatgctgggtttccccattcgggaaatctctgggatcaaagcttacttacagctccccaaagcatatcgtcgttagtaacgtccttcatggcttctagtgccaggcatccaccgtgcggccttaataacttaatctatggttccacccatttttataggtcaaacggtaacatgaggtagggtcttttataaaaaggnttaaacggggtattaatcttgtg

SEQ ID NO: 4603 - DNA, 246 bp; double-stranded, linear
gaaacgttagcacaagccatgaaccaattaggtggaaagagtaatagtggtgaaggtggcgaagatgcaaaaccgttatgaagtacaagttgatggaagcaacaaagtaagtgcgattaaacaagttgcttctgggcgttttggtgtanctagtgattatttacaacatgccaaagaattcaaattaaagttcgccaggtgcaagccctggtgaggtggtcattacctggtactaagggatatccn

SEQ ID NO: 4604 - DNA, 248 bp; double-stranded, linear
attaactaacatgggcatctacgatggaaacagacgtggtatcctcgctattatccagctancgccatgctggctcgtttttcaaatcaagccattttaaattttggaaaggtgtatggaccaagccctatgacattgcattcaccgattgaacacgatgttatcgccatgtctcatggagaaaatcaagagcatcattcagcagtatcgcgatgctacattacgcgcgattaaagcagntttgatgg

SEQ ID NO: 4605 - DNA, 246 bp; double-stranded, linear
caagttttccagtttccaatgaccctccacggttgagccgggacttntcacatcagacttaaaaaaccgcctacgcgcgctttacgcccaataattccggataacgcttgccacctacgtattaccgcggctgctggcacgtattagccgtggctttctgattaggtaccgtcaagatgtgcacagttacttaacacatgatgttcttcccctaaatgaacagagttttgttttgttttntgggtt

SEQ ID NO: 4606 - DNA, 212 bp; double-stranded, linear
cttcttaccagtcgttgtacctgtgcgattcaattgttgcactgcttgctctaaggcatgtgtatctgcagttaaatcatgtntcgcttggtttaatgctgttaatgcgttatcgacacgatgtttttcatctgaaatttgttgtgcagttgcatcgccattgtcaataacacgttgagctgcagttatttcagtttctgcttcacgctnct

SEQ ID NO: 4607 - DNA, 266 bp; double-stranded, linear
tagtcaagatgagaattctaaggtgagcgagcgaactctcgttaaggaactcggcaaaatgaccccgtaacttcgggagaggggtgctctttagggttaacgcccagaagagccgcatgaataggcccaagcgactgtttatcaaaaacacaggtctctgctaaaccgtaaggantgtataggggctgacgcctgcccggtgctggaaggttaagaggagtggttagcttctgcgagtacggaatcgaagccccagtaaacggcgg

SEQ ID NO: 4608 - DNA, 215 bp; double-stranded, linear
ttcagtacgtaaatacgcacgtgaaaaaggtgttanattaaagcagtttctggatctggtaaaaatggtcgtattacaaaagaagatgtagatgcatacttaaatggtggtgcaccaacagcttcaaatgaatcagctgcttcactgacaagtgaagaagttgctgaaactcctgcagcacctgcancagtgaacattagaaggcgacttcccag

SEQ ID NO: 4609 - DNA, 241 bp; double-stranded, linear
gggttcatacatgtcaatagtaaccgtcttaacttgttgtcgattttttaaatcgaatcgctcgaaataggcacgcaagaatcttgtagttctattttctaaaatatctataacatcatggtatcattatctataaaaatgaaactcattgatccagttacatttttaacgcttttaaattcatccatagcgatgtggttcctgccaaccattaaaggggttaattcngaatngattagcc

SEQ ID NO: 4610 - DNA, 215 bp; double-stranded, linear
attcatttcttgtctagcaacgttctactctagcggaacgtaagttagctaccatcctcgctaagaacctttcttgacttgtgacaatcgcttgcttctttcctctccttcggctctcgcttactcatttagctctactaaactcgttgcgctcttttctcgtttcgtcagattcaaacgtttcanttcgccaagccatttttctttggtgntta

SEQ ID NO: 4611 - DNA, 400 bp; double-stranded, linear
gtgccatctttcttcatcaattcattaataattgctgggacgccaccagcttcatgcacatcatgcattgaatacgatgaactaggtgctatttttgataaatatggcgtgcgtttggcaatagcattaatgcgctctaagtcataatcaataccagcttcattggcaatggctaacgtatgcagtaccgtgtttgttgaaccacggcacatcttcgccaatttcttctttaaacaagtttaaattatcttgtgattcaggtaaatccatcttgttagctactacgatttgaggtctatcttctaaacgttgctcgtacggcggctaattctggattaatgactttataatcttcaatagggtctctaccttcagaaccgctccatatccatcctgtgga

SEQ ID NO: 4612 - DNA, 258 bp; double-stranded, linear
aatactattaagaagtcctgaaaaattcacattagcagttggattgttcaactttattaatgataagtatgcaaataatttcacagtgtttgcagcaggggcaattatgattgcagtacctatagcaatcgtattcttgttcttgcaacgctatttagtatcaggtttaacaacaggtgccgaccaaagggttagtttgaatttaggagtggggccagattggttaaggaccncctaatgaccgttaaggttnaaagg

SEQ ID NO: 4613 - DNA, 210 bp; double-stranded, linear
gacttcgtttcagtgtaaaatttttctaatgtaacagatatgctattattcattggaatgattagtgcttcatcttttttaccccaatattttataagtgcaattcgtatgtgcacgtgctttgccacttttaatcaacgcttaacctcctaaattctcaatccaagtatgtgctgcaccagcttttttctacagcttttacaatattnn

SEQ ID NO: 4614 - DNA, 235 bp; double-stranded, linear
tagcgtattaatcggcggatcggctgagcgtatctgagtctgaatcgctgtctgagtctgagtcgtatccgagtctgagtcgctgtctgantctgaatcactgtctgaatccgnatcgctatctgaatctgaatcgctatccgagtctgagtcgctgtctgaatctgaatcgctgtctgagtccgaatcgctatctgaatctgagtcgctgtctgagtctgaatcgctatctgaa

SEQ ID NO: 4615 - DNA, 209 bp; double-stranded, linear
atgtgcgtggtttattttaataggttagtaatatattaggtcatgttatgtttaantttataatgaataaataatttagaaatatgcttccgattgttcgatgctttaattcagttagaagcatcatagaatgcatgattactgttgtaaagatacgtaatgttttgtattgactgtatgtcnttggatagagttacaaacttattttg

SEQ ID NO: 4616 - DNA, 222 bp; double-stranded, linear
atgcgcaagatatggagaacaccatcgcgaagcgactttctggtctgtaactgacgctgatgtgcganacntggggatcaaacaggattagataccctggtagtccacgccgtaaacgatgagtgctaagtgttagggggtttccgccccttagtgctgcagctaacgcattaagcactccgcctggggagtacgaccgcaagttggaaactcaaaggaatt

SEQ ID NO: 4617 - DNA, 258 bp; double-stranded, linear
cagtttgcaacaccccaattcttgccagtcagcatgattctgttcatttctgcgatttctttgtcgatattttcaaatcttgttggacttgatctaaatcaattggtgcttcttcttcgaatgtatcaacatatcgcggtatgtttaagttgtaatcgttatcggngatctcttgtaatgtcgcgctgtggctatatttatcaatcgtggctttacgcttatatggggctataatacgttcgaccttgggcaaccgnt

SEQ ID NO: 4618 - DNA, 216 bp; double-stranded, linear
tctaattgatagtgaatataattagagttngaggctgggacataaatccctaaatttcancagtaagataattttcaattagaaaatatcttactgctgttctctatttatacaatacttcattggaatggcttcgctttcctagggtgccgtctcagcctcggtcttcgactgggcactgctccctcaggggtctcgccatttaatactacgtat

SEQ ID NO: 4619 - DNA, 238 bp; double-stranded, linear
atgtatcgcgccgagcaacacaagataagcattgtagatgtggatgccttaactgggcaagcgattngtcgtcctaaaacaggtacatatgcgctatctgacctagtcggtttagatattgcagtgtctgtaattaaaggcatgcaacaagtacctgaagaaacacccntattttcatgatggtcaaaatttgtaaatacgttgttttgacaatgggcgcacctcggaccgtaaaacg

SEQ ID NO: 4620 - DNA, 249 bp; double-stranded, linear
aaccattgaagcaccccattacgttttggctgacacgnacgtatatcgcctgcccaagcagatgcagccttattaacacctgaaccacttcgaacgccactacctttaagtgacttcaaccatttttcctggatctttagctgtatgcattgccctggatgcgacccttgncatcaattgggaaatgtaagtgtgctcctgctaacgaaattacctgtagcacctggatttccctatcagttgaccagc

SEQ ID NO: 4621 - DNA, 267 bp; double-stranded, linear
tggacctgtaaaaggagactcgattgtagaaaaagaagaaattccattcaagaaagaacgtaaatttaatcctgatttagcaccagggacagaaaaagtaacaagagaaggacaaaaaggtgagaagacaataacgacgccaacactaaaaaatccattaactggagaaattattagtaaaggtgaatcgaagagaaatcacaaagtccgttntggnttacaggtacggcagaacgatacacagtctcgggcgattgtcgagtccac

SEQ ID NO: 4622 - DNA, 231 bp; double-stranded, linear
caaaaggtagtttaaattaggagtggggaaattgataagaccactaatgacgataaagattaaaaggangacgttatgatgacgattaaagttggatcattgggtgtggtggtattccaatggcaagcacatgccaagtttacaaaaagttgaaatgttgaaatgancgcattttgtgacgtagacatttcgaagcagcgagtgcggcagaagcatacggactgacaatgc

SEQ ID NO: 4623 - DNA, 301 bp; double-stranded, linear
cgaaaccggcccgacccggaccnacccgaggaaaggtacccnaaagntgaagcccgggaaaaccacccaaacggcccacccaaaccacccagaagtacccaaagtgaagcccggaaaacacccaacacccacccggacaccagaagtgccggagtgagccagaaactccaacaccgccaacaccagaggtaccagctgaacctggtaaaccagtaccacctgccaaagaagaacctaaaaagccttctaaaccagtggaacaaggtaaagtagtaacacctgttattgaaatcaatgaaaa

SEQ ID NO: 4624 - DNA, 222 bp; double-stranded, linear
cgaggtgctgcagaaggtgtcattcgtcgttatttaattgaagaaaagaactacttagaagctgtgattggtttgccagcgaatattttctatgggacaagtattccaacatgtattttagtatttaaaaaatgtcgccaacaagacgacaacgtactatttatcgatgcatccaatggttttgaaaaaggggnaaatcataatcattnggcgatgcccaag

SEQ ID NO: 4625 - DNA, 301 bp; double-stranded, linear
tggaaagtgaatcaaagaggtaatatccgtagtcgaaatgttgtctctcttgagtggatcctgagtacgacggagcacgtgaaattccgtcggaatctgggaggaccatctcctaaggctaaatactctctagtgaccgatagtgaacccagtaccgtgagggaaaggtgaaaagcacccccggaaggggaagtgaaattaggaaccctgaaaacccgtgtgctttaccaaagttangttcaagaggccccgtttaaattggggtnnaattggcggtgcccttttttggtaggaattgaaa

SEQ ID NO: 4626 - DNA, 223 bp; double-stranded, linear
gaatgaaggaagaccatatgaaaaatggccaacttaagccaggatacaatttacaaatagcgacaaattctcaatttgttttatcctatgacctatttcaaaacccaacagatactagaacattaatcccatttttancaatgattcaaaataccttcggttatttaccagagtatattgtagctgatgcaggttatggtagtgagcaaaactatatggcnat

SEQ ID NO: 4627 - DNA, 221 bp; double-stranded, linear
ttgttggggccccgccngcgncattgcctgtagaatttcttttcgaaattctctgtgttggggcccctgactagaattgaaaaaagcttattacaagcgcattttcgttcagtcaattactgccaatataacttcgtagatcatagaacattgatttatttcccagcctattcttttcataaaaaaaagacggattaattatccgctttttccttatatct

SEQ ID NO: 4628 - DNA, 208 bp; double-stranded, linear
atatattcgtatttatagtaaaattaaataaagagnattatataacacgaggtgtagtaagtatgaaatttgagnaaatatatagatcacactttattggaagcctgagtcaacacgtacgcaaatcgatcaaatcatcgatgaagcgaagcataccaattttaaatctgtatgtgtgaatccaccacatgttaaatatgcagcagag

SEQ ID NO: 4629 - DNA, 305 bp; double-stranded, linear
acaataatgcatcataatgcgcaacaacaatcaatactgcgaaaacagaagcacaacaagtgattaataatgagcgtgcacaccacaacaagtttctgacgcactaactaaagttcgtgcacacaactaagattgatcagctaaagcttacttcaaaataaagagatatagccattagtaacgttaaaataacttacaagntctgtgaccagtacctcactgtggtatgacgcacaagtattgatactntatcgagagcgtgagngaactgaatactgcgctcacggtattacatgcgtgcactg

SEQ ID NO: 4630 - DNA, 213 bp; double-stranded, linear
tcgactaccatcgacgctaaggagcttaacttctgtgttcggcatgggaacagtgtgactccttgctatagtcaccagacatatgaatgtaattatacattccaaactagatagtaagtaaaagtgatttgcttcgccaaacatttattttgattaagtcttcgatcgattagtattcgtcagctccacatgtcaccatgcttccanctngaa

SEQ ID NO: 4631 - DNA, 213 bp; double-stranded, linear
gangtgaaatagaacctgaaaccgtgtgcttacaagtagtcagagcccgttaatgggtgatggcgtgccttttgtagaatgaaccggcgagttacgatttgatgcaaggttaagcagtaaatgtggagccgtagcaaaaacnaagttctgaatagggcgtttagtatttggtcgtagccggaaaccaggtgatctacccttggtcaagttgaa

SEQ ID NO: 4632 - DNA, 205 bp; double-stranded, linear
gcttttaaatcaaatgatagcggaagggnattttaaaattattcgaaccattatttacagcagcagatggatggattggtgtcacaattatctttggtgcctttgcattattctggtttgtaggtattcatggtccgtcaattgtagagccagcaattgcagccattacatatgcgaatatcgaagcgaacttcaagttgcttca

SEQ ID NO: 4633 - DNA, 204 bp; double-stranded, linear
agttatattgacagtagttgatggggccccaacatagagaaattggaacaccaatttctacagacaatgcaagttggggtgggctctaacataaagaantactttttctntagaaattagtatttcttatacatgggttttactcagtatttcctattcttaagtgcacattagcagcggctaatgtgttaagaactactacat

SEQ ID NO: 4634 - DNA, 226 bp; double-stranded, linear
gccgatggattagagtatatgacgtggtggcatgtcattaatttaggtgatgtaggtaagaacgttngggcaaggtatgagtggtggtattgcgttacgttagcccgtctgatgtagaagcttttgttgaaaataatcaactagatacgctttcgtttacaaagattaaacaccaagaagaaaaagcattcattaagcaaatgctggaaganccatgtgtcacaca

SEQ ID NO: 4635 - DNA, 208 bp; double-stranded, linear
catatagttttgctcactaccataacctgcatcagctacaatatactctggtaaataaccgaagagttgttgaatcattgttaaaaatgggattaatgttctagtatctgttgggttttgaaataggtcataggatanaacngtacggagaatttgtcgctatttgtaaattgtatcctggcttaagttggccatttttcatatggtc

SEQ ID NO: 4636 - DNA, 228 bp; double-stranded, linear
tttttctttgtgtttatttttattttgaacgttttaggacataaaaaaaagtagaccttgcggtctcaatgcggctcatcgcatccattttttgcctggcaacgttctactctagcggaacgtaagttggctaccatcgacgctaagaacctttcttgacttgtgacaatcgcttgcttctttccgcttcttctgctcgngcttactcattgagcnctactaaactcg

SEQ ID NO: 4637 - DNA, 212 bp; double-stranded, linear
catggttcaaaagtgaaagacggtcttgctgtcacttatagatggatccgcgctgcattagctagttggtaaggtaacggcttaccaaggcaacgatgcatagccgncctgagagggtgatcggccacactggagctgagacacggtccagactgctacgggaggcagcagtagggnatcttccgcaattggcgaaagctgtacgggcaacg

SEQ ID NO: 4638 - DNA, 256 bp; double-stranded, linear
atntnattaaatagagaacagcagtaagatattttctaattgaaaattatcttactgctgttttttagggatttatgtcccagccatttttgtattcatatttaaatttcgataatttttcaggaagcattttaattttactaatgaagccatatttttagattaaccaaaattaatatttacatttcctaaccatttttatgtaacatttacagttccaaaaatgggggtaataatccaggttaggataaagagg

SEQ ID NO: 4639 - DNA, 209 bp; double-stranded, linear
anagnaaccactacataataaatcattagtggctctttatcatttctgtcccactcccctgagaagtttaaaattttatatgttggcttgttatgttaagggaattaacatggttgtcttgtttatattatgtgattccaacattactagtcctggtaaatctaattccgtaaaatgctaaatctaaccatctattaaattttaaaacc

SEQ ID NO: 4640 - DNA, 224 bp; double-stranded, linear
ngnaaaggtgaaaagcaccccggaagggaggtgaaatagaacctgaaaccgtgtgcttacaagtagtcagagcccgttaatgggtgatggcgtgccttttgtagaatgaaccggcgagttacgatttgatgcaagttaagcagtaaatgtggagccgtagcagaagcatggtctgaataggtgcgtttagtatttggtcgtagcccgcagaaccagggtgatct

SEQ ID NO: 4641 - DNA, 205 bp; double-stranded, linear
cactcacncagatttttaagtcctgtgcgtctgccagttccgccaccccggcactataaaaatggagcagaagacgggattcgaacccgcgaccccaaccttggcaaggttttattctaccgctgaactacttctgcatatgcgggtgaagggagtcgaacccccacgccgtaagctangatcctaagtctagtgcgtctgccaa

SEQ ID NO: 4642 - DNA, 235 bp; double-stranded, linear
agctgacatgatcagtcagcttacaacaatgtgccggttggggtggctggacacggcaccctgagggaagggcacccgtcatcaaaaattctatttatagaattttacagtaatgtgacagacgggcaaagcgaaccattcaatacgaagtattgtataaatagagaacagcagtaagatattttctaattgaaaattatcttactgctgtntttttagggatttatgtncccag

SEQ ID NO: 4643 - DNA, 260 bp; double-stranded, linear
agnaaggtggggatgacgtcaaatcatcatgccccttatgatttggctacacacgtgctacaatggacaatacaaaggcagcgaaaccgctagtcaagcaaatcccataaattgttctcagttcgattgtagtctgcgactcgactacatgaagctggaatcgctataatctagatcagcatgctacgtgatagttccgggtctntacacacgcccgtcacaccacggagggttttacaccgaagccgtgatacttttag

SEQ ID NO: 4644 - DNA, 285 bp; double-stranded, linear
cagcaggccaccaaaattgtggtccgagatgttcatataaaactttatataattcatcagttcctaacatttacaccctccattttagagggagtgggacagaaatgatattatcgtaaaatttatttcgtcgtcccaccccaacttgcatgtctgtagaaatggggatccaattcncttgttgggggcccgcgggcaaggtnactagaatgaaaaaagcctgttacaagcgattttcggttcagtccactactggcaatataacttgtagagctaggacattgg

SEQ ID NO: 4645 - DNA, 206 bp; double-stranded, linear
gctattactctgctatcaatgtacctaaagctaccgatgatttccgagacatagaccgtgcgcttgtntgggggttcaactggaaacttggtccattccaattatgggatgcaatggggntacgaacgtgttaaaacagtatggaagacgaacttggagacttaccacaatgggttagtgatttagatggtggcttttgataaaca

SEQ ID NO: 4646 - DNA, 222 bp; double-stranded, linear
acagttaccgatacaactgaagatgataacgatgcagatggtggcgacgttgacgtcacacttacggatcatgatgatttcacacttgataacggatacttcgagatgatacatcagacagcgattcagactcagatagtgactcagacagcgactcagactcagacagcgactcagactcngacagtgattcagattcagacagcgactcagattcngata

SEQ ID NO: 4647 - DNA, 200 bp; double-stranded, linear
gtactattcgtgtgtgacaatgttcttccagcatttgcttaatgaatgctttttcttcgtttaatctttgtaaacgaaagcgtatctagttgattattttcaacaaaagcntctacatcagncgggataacgtaagcaataccaccactcataccttgaccgaagttcttacctacatcaccgaaattaatgacagtcca

SEQ ID NO: 4648 - DNA, 201 bp; double-stranded, linear
ccaccattaatttaatacctatttgggggcttagctcagctgggagagcgcctgctttgcacgcaggangtcagcggttcgatcccgctagtctccaccattatttgtacattgaaaactagataagtaagtaaaatatagattttaccaagcaaaaccgagtgaatanagagttttaaataagcttggaattcattaaga

SEQ ID NO: 4649 - DNA, 218 bp; double-stranded, linear
agtaaatacagatggaataaatcttttaaggcttataaacgctcatctgncattgtagcaattcatgctttcaaaagacgatatactacgacactcctacgaacttgtccaaggattacgaaaagacctaaggttatgtaattggcctaaattcattaatcgcttaaattcacttagtaaaaagtctgtgagtaagggtgtatggaaagtggtnaaat

SEQ ID NO: 4650 - DNA, 202 bp; double-stranded, linear
gtggcggtgcgactgtcagaagcacgttaaattaatgaaagatacagtaggtgctgatgtagaagtaaaagccatcaggtggcgtacgtaatttagaagatttcaataaaatggttgaagcaagtgcgacacgtattggtgcgagcgcaggtgttcaaattatgcaaggtttagaagcagattcngattactaatatntatg

SEQ ID NO: 4651 - DNA, 209 bp; double-stranded, linear
agcggcggacgggtgagtaacacgtggataacctacctataaaactggnataacttcnggaaaccggagctaataccggataatattttaaaccgcatggttcaaaagtaaaagacggtcttgctgtcacttatagatggatccgcgctgcattagctagttggtaaggtaacggcttaccaaggcaacgatgcatagccgacctgaga

SEQ ID NO: 4652 - DNA, 202 bp; double-stranded, linear
tgaagatgcaggttacccgcgacaggacggaaagaccccgtggagctttactgtagcctgatattgaaattcggcacagcttgtacaggntaggtaggagcctttgaaacgtggagcgctacttgantggttaggcgctggtgggatactaccctagctgtgttggctttctaaccctgaccacttatcgtggttggagaca

SEQ ID NO: 4653 - DNA, 205 bp; double-stranded, linear
ccgtgcgacccctttggtcccaaaccaagtgctctaccaagctgagctacgttcccggtataattaacgcgcccgataggagtcgaacccataacctcttgatccgtagtcaaacgctctatccaattgagctacgggcgcatatgtttttattgaaaatggtgccgaggaccggaatcgaaccggtacgtgatcactcaacngn

SEQ ID NO: 4654 - DNA, 264 bp; double-stranded, linear
agacgaaacgttgttgttgcgaagataaatcgcacagcgattgagcctatctgctgcaccattaactggtgaagtaacaccattatcagaagtgcctgatcaagtgttcagcgaaaaaatgatggtgacggtatcgctatcaaaccttcacaaggtgaagttcgtgcaccattcaacggtaaagtaccaatgatttcccaaccaaacatgccattggtcctgtatcagatagtggttagnctattaatccacacgggttagang

SEQ ID NO: 4655 - DNA, 211 bp; double-stranded, linear
gacgattacatatcatcgctaataacttagcattaaaaccgcttgatgcgccaccacaagccccacattcaagtgatgcatgatgtggattattgtgagaatgactagcatggccctgctaacacaacgaactgggnacatgcttcggttaaatccatcaatttcaacgcttgtnacgcgaaatcagtttgctcttggctgcagtaaatcg

SEQ ID NO: 4656 - DNA, 212 bp; double-stranded, linear
tttacatttatcggtttagtcagattcaaacgttttcacttcgccaagccatctttctttgtgtttgcttttattttgacgttttagacataaaaaaagagaccttgcggtctcaatgcggctcatcgcatccactttttgcctggcaacgttctactctagcggaacgtaagttcgactaccatcgacgctaaggngcttaactgntgggt

SEQ ID NO: 4657 - DNA, 200 bp; double-stranded, linear
tgggttcgaantccacttaggacccaccattaacttaatacctatttgggggcttagctcagctgggnagagcgcctgctttgcacgcagaggtcagcggttcgatcccgctatctccaccattatttgtacattgaaaactagataagtaagtaaaatatagattttaccaagcaaaaccgagtgaataaagagtttta

SEQ ID NO: 4658 - DNA, 185 bp; double-stranded, linear
tacagtatatcgggaagacaggattcgaacctgcgaccccttggtcccaaaccaagtgctctaccaagctgagctacttcccgtataattaacgcgcccgataggagtcgaacccataacctcttgatccgtagtcaaacgctctatccaattgagctacgggcgcatatgtttttattgaaaan

SEQ ID NO: 4659 - DNA, 208 bp; double-stranded, linear
aagtgttagggggtttccgccccttagtgctgccagctaacgcattaagcactccgcctggggagtacgaccgcaagtgtataactcaaaggaattgacggggacccncacaaggttggagcatgtggtttaattcgaancaacgcgcagtaaccttaccaaatcttgacatcctttgacaactctagagatagagccttccccttcg

SEQ ID NO: 4660 - DNA, 365 bp; double-stranded, linear
acgtcgcgagaacgcaattagctgaaaaagattacaacattagaacaagatttaaagtcacatttagtgaacatcaaaggccgaataacatcataaattacgattagatataacaaaagagcttgggacataagtcctaaagtcttaggcaagtaaaaaagtgatttctattatttatttgatagaaatcactttttgatatgtatttntatgtacagctcgttgagcnctattttccttatattagtgccataatacaaacctagctcttgtttaactttattattccgaactgacatcggtgaacccaatagcctcataagcaaacagcttacatcattttcttgantggttttcgttctgtc

SEQ ID NO: 4661 - DNA, 209 bp; double-stranded, linear
aaagtatttctttatgttggggggcaccccactttgncattgtctgtagaaattgggaatccaattctcctnatgttggggccccgcagttcaactactgccaatatagtgttgtagtgtctaagacataaaagttcatctcagtcacaattactttatagcctatccatcatcttttctacatgaaatttttccaagtgatatatttt

SEQ ID NO: 4662 - DNA, 246 bp; double-stranded, linear
ttatggcacttaaaaccagcgatgacgattgcagtatcacatggtatcttcaacataacaaatactttgattcaattaccatttgtagcaggtttagcatggattgttacaaagcttgtcccaggtaaagatattgctgatgactataaacctcagcacttaaaccaaggtctgttatcacgcacctggtgtttgcataccaggaactccaaaaggattaccaaatgtnggggcagantggcctaa

SEQ ID NO: 4663 - DNA, 226 bp; double-stranded, linear
aatggtgtattatgagtagtaataattagcaaagaggtaaattaagtgatgtcgcgtcatttaaggaagcgattcacaatcgagaatcacaaagtacaactggtatcggcgaaggtatngccattccacatgccaaagtggccgcagttaagtcaccagctattgcgtttggtaaatctaaagcaggcgtagattatcaaagnttttggtatgcaaccagcacact

SEQ ID NO: 4664 - DNA, 234 bp; double-stranded, linear
ttccgtctcggcaccattttagcgccgtagctcaattggatagagcgtttgactacggatcaagaggtatgggttcgactcctatcgggcgcgcatttttaaattaattgaataacgggagtagctcagcttggtagagcacttggtttgggacaagggcgcaggttcgaatcctgtctcccgattacttctaaatccatttatggggctactcactgggnacgcctcttncac

SEQ ID NO: 4665 - DNA, 196 bp; double-stranded, linear
gtacatctaaaatcatccatgaaggtttgttacctgaattacggaatgattcaacaacttctaaacgtttaattnaccagtaagtctttgccaagtagctgattccaactcatcgcgtacaatttaagtcttcgtcaagatcaatcctcttcaagtaaatctttaataaccttctgcacccatttttgcacgaatt

SEQ ID NO: 4666 - DNA, 226 bp; double-stranded, linear
ccgccgaacaactactttgtttgttgattctctccacctgtttcagtagttcagatttcttagattgtggttttttagttggtgccatgctttaaccttttcattgatttcaataacaggtgttactacttacctgttccacggtttagaaggcttttaggttcttcttggcagtggtanggtttaccagttcagcggtaccgcggtgttggncgtgttggatttc

SEQ ID NO: 4667 - DNA, 187 bp; double-stranded, linear
gttctgaatagggcgtttagtatttggtcgtagccganaaccggtgatctacccttggtcaggttgaagttcaggtaacactggaatgggaggaccgaaccgacttacgttgaaaagtgagcggatgaactgagggtagcggagaaattccaatcgaacctggagatagctggttctctccgaaata

SEQ ID NO: 4668 - DNA, 182 bp; double-stranded, linear
ctaagtggagttgtcacaacatctttaaacgttccaggtaaatagtcttttgccatttctgaaaatgcttttgccaacgttttataaatatcccagtctgaacgcgattcccataacggatcaatggcaggattgaaaggatgtacatatggatgcatatccgttgatgataaatcatgntt

SEQ ID NO: 4669 - DNA, 182 bp; double-stranded, linear
agttacgttaaaagatgaaaacgacaaagttttaaaaacagttacaacagatganaatggtaaatatcaattcactgatttaaacaatggaacttataaagttgaattcgagacaccatcaggttatacaccaacttcagtaacttctgggaaatgatactgcaaaaagattctaatggttt

SEQ ID NO: 4670 - DNA, 185 bp; double-stranded, linear
ggggcaaagtcattncatagattaatggttctccgatacctaggaaaccaactggcaatgcaccttttaaagtattacgtaatgttgtgttgcgtttacatcttacccaaagtgctaatgcggcacctacttgtccagcaccagccatcgctgcaattggcaataagtaagtagcacctgattgg

SEQ ID NO: 4671 - DNA, 200 bp; double-stranded, linear
ctgacgaacgagaaaagagcgcaacgatttagtagagtaaatgagttaagcgagaccgaagaagaggaaagaagcaagcgattgtcacaagtcaagaaaggttcttagcgttcgatggtagccaacttacgttccgctagagtagaacgttgccaggcaaaaaaatggatgcgatgaccgcattgagaccgcaaggntnt

SEQ ID NO: 4672 - DNA, 261 bp; double-stranded, linear
cccggggtacagttattccccagagtcaacgcgggggttggactcgatgtcggtcatcgcatcctgggctgtagtcggtcccaagggttgggctgttcgccattaaagcgnacgntgctgggttcagacgcgtgagcagtcggtccctatccgtcgtgggcgtaggaaatttgagagggctgtccttagtacgagaggccgggatggcataccttggtgtaccattgtcgtgccacgcatagtgggtagtatgtgtggacg

SEQ ID NO: 4673 - DNA, 184 bp; double-stranded, linear
atagggcgtttagtatttggtcgtanccagaaaccaggtgatctacccttggtcaggttgaagttcaggtaacactggatggaggaccgaaccgacttacgttgaaaagtgagcggatgaactgagggtagcggagaaattccaatcaaacctggagatagctggttctctccgaaatagcgtt

SEQ ID NO: 4674 - DNA, 203 bp; double-stranded, linear
cccagtcaaactgcccgcctgacactgtctcccaccacgataaggtcgtgggttgagaaagccaacacagctagggtagtatcccaccagcgtnctccacgtaagctagcgctcacgtttcaaaggctcctacctatcctgtgacaagntgtgccgaatttcaatatcaggctacagtgaaagctccacggggttctttccgt

SEQ ID NO: 4675 - DNA, 229 bp; double-stranded, linear
nngtttgtaaataatatggtggagactagcgggatcgaaccgctgacctcctgcgtgcaaagcaggcgctctcccagctgagctaagcccccataataattacagtatatcgggaagacaggattcgaacctgcgaccccttgggtcccaaaccaagtgctctacccagctggagcttactttcccggtattatttaacgcggcccgatagggagtcggaacccattaa

SEQ ID NO: 4676 - DNA, 178 bp; double-stranded, linear
tctaaaaatcgcgcacttaaaccgcttatgacaatcattattacctcaatatgcttgtcatcacttgcctttatcgtcgttcattggctatatagttaatatgaaaagacgctcaaacacttacaaatttagtgtgcngagcgtcttatttttatactttaaaagtcgtattggttgt

SEQ ID NO: 4677 - DNA, 286 bp; double-stranded, linear
gcaagtaagcataatgtggagccgtagcgaaacagtctgaatagggcgtttagtatttggtcgtagaccggaaaccaggtgatctacccttggtcaggttgaagttcaggtaacactgaatggaaggaccgaaccgacttacgttgaaaaatgagcggatgaactgaaggtaaccggagaaaatcccaatcgaaccctgggagataagcttgggntctcctcccgaaaataagccttttaggggcttaagcctccaaagtggatgatttaatttggaaggtaaaan

SEQ ID NO: 4678 - DNA, 229 bp; double-stranded, linear
cacacggcttatggtaacaaaaaattcctttggagcattatggagcggaagataggtttacacctatacctcgttccggaaggantgttctaaaagtgaactactcccgcaatattaaatatggagcggagataggatttacacctatacctcattccagaggatgtattctaagagtgaaatactccccatatattaaatatggagcggagataggattgaccatacn

SEQ ID NO: 4679 - DNA, 173 bp; double-stranded, linear
atgactgctttttattatactttacatttctcgtttcgtcagattcaaacgttttcacttcgccaagccatctttctttgtgtttgcttttattttgacgttttagacataaaaaaagagaccttgcggtctcaatgnggctcatcgcatccactttttgcctggcaacgttc

SEQ ID NO: 4680 - DNA, 183 bp; double-stranded, linear
aaaagtaacaagagaaggacaaaaaggtgagaagacaataacgacgccaacaaaaatccattaactggagaaattattagtaaaggtgaatcgaaagaagaaatcacaaaagatcccattaatgnattaacagaatacggaccagaaacgataacaccaggtcatcgagacgagtttgatccc

SEQ ID NO: 4681 - DNA, 203 bp; double-stranded, linear
cggtgctttcactttcctacagactggttactatcggtcagagagagatttagcnttaggagatggtcctcccagattccgacgaatttcacgtgttccgtcgtactcaggatccactcaagagagacaacattttcgactacaggattantaccttctttgattcatctttccagatgattcgtctaatgtcgtcctttgta

SEQ ID NO: 4682 - DNA, 187 bp; double-stranded, linear
gggtcacacctgttcccatgccgaacacagaagttaagctccttagcgtgcgatggtagtcgaacttacgttccgctagagtagaacgttgccaggcaaaaagtgggatgcgatggagccgcattggagaccgcaagcctctgttctttgatgtctaaaacgtncaaaataaaagcgaacacaaaga

SEQ ID NO: 4683 - DNA, 187 bp; double-stranded, linear
ggctacactggtcatgatgctgctaaactacgtgattatnatgaaacacatcatgctttgtctggatatgaaatgattgacgcagcaaaggtgccattgcaacaaatgaagtcaatgctgcgatgggtatatttgtgcaacgccaacaactggttcctccggtaccatcccggtgcagttttaaatt

SEQ ID NO: 4684 - DNA, 168 bp; double-stranded, linear
agtgccaaggcatccaccgtgcgcccttaataacttaatctatgtttccatcctacaggaaaccgttattaatcttgtgagtgttctttcgaacactagcgattatntcttatgaattcaagcttatttaaaactctttattcactcggttttgtaaaatctatattt

SEQ ID NO: 4685 - DNA, 168 bp; double-stranded, linear
acgggaagtagctcagcttggtagagcacttggtttgggaccaaggggtcgcaggttcgaatcctgtcttcccgattacttcttaaattccattttatgggggcttagctcagctgggagagcgcctgctttncacgcaggaggtcagcggttcgatcccgctagtct

SEQ ID NO: 4686 - DNA, 174 bp; double-stranded, linear
atgattcaagcttatttaaaactctttattcactcggttttgcttggtaaaatctatattttacttacttatctagttttcaatgtacaatttctttttagtcaagcgctcgcatactgcnttattttcaaaaaatcaaatgctcatttacaaaagtaaactccgcttttaatt

SEQ ID NO: 4687 - DNA, 166 bp; double-stranded, linear
tgttgttgaatatgaagaagatacaaacccaggtggtggtcaggttactactgagtctaacttagttgaatttgacgaagagtctacaaaangtattgtaactggcgcagtgagcgatcataccacagttgaaggtacgaaagaatatacaactgaagtaatctga

SEQ ID NO: 4688 - DNA, 189 bp; double-stranded, linear
agaaccttaccaaatcttgacatcctttgacaactctagagatagagccttccccttcgggacaaatgacagtggtgcatggttgtcgtcactcgtgtctganatgttgggttaagtcccgcaacgagcgcaacccttaagctattgccatcattaagttgggcatctaattgactgccggtgacaaac

SEQ ID NO: 4689 - DNA, 227 bp; double-stranded, linear
taaccactcctcttaaccttccagcaccgggcaggcgtcacccctatacatcaccttacggtttagcagagacctgtgttttttgataacagtcgcttngggctattcactgcggctcttctgggcgttaaccctaaganacccttctcccgaagtacgggggcattttgcgagtcctaacgaggtcgtcgtcacttagattctcatcttgatactgtgtggttgcg

SEQ ID NO: 4690 - DNA, 174 bp; double-stranded, linear
agataatgcaccatcaactaatggatatttatgtccagttgggggccagaaatcataaacgtcttcagtgtaagcaacagcatcttcatttngcagccaaaatgcttggattatgtgcaataaccatcgcaactgcgccacaccttgtgttggctcgccgcctgaagtggggtg

SEQ ID NO: 4691 - DNA, 363 bp; double-stranded, linear
tttttttttaaaaaaagggaagggaaaanaaaaagggaaaaaaatttaacccaagggtttttaaagggggcccaatttttcccaaaaaaaaaaccctttgggttaaattttttttaaaaacccaacccaaaanttttttaaaaagggttttgggccccccttgggaaaaatttttcccgggttaaatttttttaaaaagggttcccttttaaattttgggaaaaacccccttttttttttttaagggaatttaaaaaatttaaggccctcccctaaattaaaattaaaggtgggaaaaaaaaaattaattaaanaacccattttttttttttaattttttaacccaaagggggtaatttggcc

SEQ ID NO: 4692 - DNA, 210 bp; double-stranded, linear
tagtgtcaattttattgatatttgcaattaaactgaaatttaatttttcggatgtattttntttacttaaagtaaaatagaacacgattttgatgtctgggaatagtggaaatgataaaaactactaatgattgattaagtagtggttcttaacattagcctcagctaattgttacttaaaaataggaatacatgagtaaaactcantgg

SEQ ID NO: 4693 - DNA, 209 bp; double-stranded, linear
atagtagtaaagtattttcttccaaacatttattttgattaagtcttcatcattagtattctcagctccacatgcaccatcttccacctcaacctattaacctcatcatctttaggatcttataaccaattggaaatctcatcttgaggnngcttcatcttagatgctttcacacttatccctccacacatagctacccagctatccgt

SEQ ID NO: 4694 - DNA, 222 bp; double-stranded, linear
gcacattaaccnaagcaccaggccatatagcaattgttgatacagtatttaaatatttagcatgtgacggaatagttacatatgtattcactaaggccataatgacaaatccattaaaaagttggatgcttattcgaccctgctagatgatctgatgaacggaacgcatattaaataagtacgtggttatggatcagtaagatactctaccagttaccagng

SEQ ID NO: 4695 - DNA, 159 bp; double-stranded, linear
tcgttctcaatagaatgatttaaatcttcgatttctttatctaaatgactaccaattaaatctatttcttctattgttaaatcgctatctccatcttcttttatctctggtattatnttttcttcaactaagtcacgatataatgtttttgaattttcg

SEQ ID NO: 4696 - DNA, 161 bp; double-stranded, linear
aatatggtagtttttaacttatctattaaggtacaattgaccaaatcgataaaacaaataatacgtatcgtcagacaatttatgtcaatccaagtggagataacgttattgcgccggttttaacaggtaatttaaaaccaaatacggatagtantgcatta

SEQ ID NO: 4697 - DNA, 170 bp; double-stranded, linear
ccaaactcaatatggctttattggcacagggaacagatatggaaggttttatttatggntgatgggtgttaatgaacatggcgttgccatttcaacacaatatttccgaggttatagttcatatgggatcaacacacaaagccggacgcagtgaatattacgcaaaatga

SEQ ID NO: 4698 - DNA, 161 bp; double-stranded, linear
ccacggctaactactgccagcagccgcgtaatacgtagtggcaagcgttatccggaattattgggcgtaaacgcgcgtaggngttttttaagtctgatgtgaaacccacggtcaaccggagggtcattggaaactggaaacttgagtcagaagaggaagtg

SEQ ID NO: 4699 - DNA, 248 bp; double-stranded, linear
taaatcttcatcaatatgatctaaccaatattgataaaaccttgatgtgtttcgtgtcaatgacataccatatcgactaggtacctttttagaatgttgattaatcacaacaaatatcatgggcaaggtcatcttgcaaaatggattcgattcaagtgggagggncgatgatggacgtgctgcatgcactgatgaccctttttgcccattctggcaaatcccaccatgaaatgactgacgcggacgcn

SEQ ID NO: 4700 - DNA, 175 bp; double-stranded, linear
cccgacgaagcgaacgtttggcactgtctcaacgagagactcggtgaaatcatagtacctgtgaagatgcaggttacccgcgacaggacggaaagaccccgtggagctttactgtagcctgatattgaaattcggcacagnttgtacaggataggtaggagcctttgaaacgtgg

SEQ ID NO: 4701 - DNA, 177 bp; double-stranded, linear
tacagggtagtgagatttcgaaacaatatggagaagcaggacttcctggaaaatacaattaatgtttatacgaatggtcatgctggtcaaagttcttgcaggcatatgcaccgaaagcttaatgattcatcatactggagatgcgaatgactatgttgggtaaaggatttatctggt

SEQ ID NO: 4702 - DNA, 156 bp; double-stranded, linear
cgattggattgcacgtctaagcagtaaggctgagtattaggcaaatccggtactcgttaaggctgagctgtgatggggagaagacattgtgtcttcgagtcgttgatttcacactgccgagaaaagnctctagatagaaaataggtgcccgtaccg

SEQ ID NO: 4703 - DNA, 166 bp; double-stranded, linear
cttgaaaaagatggttattctgttgaagtaattgacttacgtactgttcaaccaatcgatgttgacacaattgtagcttcagttgaaaaaactggtcgtgcagtngtcagcaagacgcacaacgtcaagctggtgttggtgcagcagttgtagctgaattaagtga

SEQ ID NO: 4704 - DNA, 153 bp; double-stranded, linear
gcggtgtcttaaccgcttgaccaaggagccatggctccacaggtaggnctcgaacctacgaccgatcggttaacagccgatagctctaccactgagctactgtggattaatattatgcctggcaacgttctactctagcggaacgtaagttcg

SEQ ID NO: 4705 - DNA, 163 bp; double-stranded, linear
aggtagagcactgtttggacgaggggcccctctcgggttaccgaattcaaacaaactccgaatgccaattaatttaacttgggaagtcagacacatgggtgataaggtccgtattcgaaanggaaacagcccagaccaccagctaaggtcccaaaatatatgt

SEQ ID NO: 4706 - DNA, 203 bp; double-stranded, linear
taaggttgggattgtttgtgggctcgttgccacccattgtacggcactcatcanttcaagccaccagctacagtatatctccttgaccagccataatttgattggctgcagtcgcgatggtttgtaatcctgatgagcagtagcgattcatgtttgaccngtacccgtcagatatccgcagcaatgcaatgttgtgcaagttt

SEQ ID NO: 4707 - DNA, 153 bp; double-stranded, linear
cgggtgagaatccgtccaccgattgactaaggtttccagaggaggctcgtccgctctgggttagtcgggtcctaagctgaggcgcagngtaggcgatggaataacaggttgatattcctgtaccacctataatcgttttaatcgatggggggc

SEQ ID NO: 4708 - DNA, 150 bp; double-stranded, linear
nctataatgaataaataatttagaaatatgcttccgattgttcgatgctttaattcagttagaagcatcatagaatgcatgattactgttgtaaagatacgtaatgttttgtattgactgtatgtctttggatagagttacaaacttatt

SEQ ID NO: 4709 - DNA, 156 bp; double-stranded, linear
aaaattcgggttctcaaatcatcggaacataacaaaacaacctaagcaacatgtaggccgttgtcacttaacttcttgtttttccgatgacagcttctattnagagaatgtcatgattattttatattcacttcaatgttatcagtattagtgcca

SEQ ID NO: 4710 - DNA, 149 bp; double-stranded, linear
gttgatattcctgtaccacctataatcgtttaatcgatgggggggacgcataggataggcgaangtgcgattggattgcacgtctaagcagtaaggctgagtattaggcaaatccggtactcgttaaggctgagctgtgatggggagaa

SEQ ID NO: 4711 - DNA, 160 bp; double-stranded, linear
ttgacttcaataccatgggccaggtacnctttaaatgttgttgtctcagttaatattaattggcttttcttttgcataattgacaatggcttctgccaatgggtgttcagaatctttttcagcagtagcaagtagttggtagcgtttgattggtcaccag

SEQ ID NO: 4712 - DNA, 151 bp; double-stranded, linear
atagtgaaccagtaccgtgaggacnaggtgaaaagcaccccggaacgacgtgaaatagaacctgaaaccgtgtgcttacaagtagtcagagcccgttaatgggtgatggcgtgccttttgtagaatgaaccggcgagttacgatttgatgc

SEQ ID NO: 4713 - DNA, 145 bp; double-stranded, linear
accagttgatctacccttggtcaggttgaagttcaggtaacactgaatggaggaccgaaccgacttacgttggaaaagtgagcgggatgaactgngggtagcggagaaattccaatcgaacctgggagatagctggttctctccg

SEQ ID NO: 4714 - DNA, 151 bp; double-stranded, linear
tgtnacgcagagatcgcgggttcgattcccgtcgagaccgccatttaattttataattaatagcgatgtacctataataatggaggaatacccaagtccggctgaagggatcggtcttgaaaaccgacaggccttaacgggccgcgggggt

SEQ ID NO: 4715 - DNA, 151 bp; double-stranded, linear
tcgtattgaatggcttcgtttcctagggtgccgtctcagcctcggtcttcgactggcactgctccctcaggagtctcgccattaatactacgtattaacgtgtaattttactttgnaatactttaaaaaaataagacactttgccaacttg

SEQ ID NO: 4716 - DNA, 152 bp; double-stranded, linear
gctgtcatcggaaaaacaagaagttaagtgacaagggtttacatgttgcttagcttcttttattatgcgtaatgatgtaaaaagacgaatattcatttgtttgtaaaagtggcatttctatgtcttaaaagtgacgaaacttcacnctgtgc

SEQ ID NO: 4717 - DNA, 144 bp; double-stranded, linear
ggatactagtaaaaccatatttagtaaatacagatggantaaatcttttaaggcttataaacgctcatctgacattgtagaattcatgctttcaaaagacgatatactacgacactcctacgaacttgtccaaggattacgaaa

SEQ ID NO: 4718 - DNA, 145 bp; double-stranded, linear
atcataaggggcatgatgatttacgtcatccccaccttcctccggtttgtcaccgcagtcaacttagagtgcccaactnaatgatggcaactaagcttaagggttgcgctcgttgcgggacttaacccaacatctcacgacacga

SEQ ID NO: 4719 - DNA, 156 bp; double-stranded, linear
aaatacctttccacgatcttcagctgggcgcctctgcactcgcaaacgcacttgatgcatcaacaacaccaccaaatagtccctgcaataacctcacagtacaaactgtaatggtgtcgtacacnatgccatttaaaaatagcataccggcaaagc

SEQ ID NO: 4720 - DNA, 152 bp; double-stranded, linear
ttaaatcgagtctcttttacaggtccatattttgttacgtatcgaccggtggctaactacgtctcctgtttctggattcttaattccggtttactggaacttcttctttctctcngttggtaactcggatcaaattcgtctcgatgacctgg

SEQ ID NO: 4721 - DNA, 146 bp; double-stranded, linear
cactagttcaagttcaagtggcgacgattggtattttacaagaattttatcaacaaggatttaattagcttaaacgcngcaatccctgtgttactagggcggataacattggtaccacggttacagctatcttagctagtttagcc

SEQ ID NO: 4722 - DNA, 156 bp; double-stranded, linear
ccacaccaatattttgcgctaagtanatcgcattaaacgtttgtcttccgccatttgagccacactgctccagctcatagcgctatatcgcagggaataatcattccgccaccacaaccctaacattacccagccatacagccataccagggccac

SEQ ID NO: 4723 - DNA, 161 bp; double-stranded, linear
acggtcttgctgtcacttatagatggatccgcgctgcattagctagttggtaaggtaacngcttaccaaggcaacgatggcatgagccgacctggagagggtggatcgggccacactgggaactgagacacggtccagactcctacggggaggcagcagta

SEQ ID NO: 4724 - DNA, 165 bp; double-stranded, linear
cagaaagctcacggggctttcgtctgtcgcgggtaacctgcatcttcacaggtactatgatttcaccgagtctctcgttgagacagtgcccaaatcgttacgnctttcgtgcgggtcggaacttacccgacaagtaatttcgctaccttaggaccgttatagtta

SEQ ID NO: 4725 - DNA, 149 bp; double-stranded, linear
ggacgttataagtgctgaaacatctaagcatgaagcccccctcaagatganatttcccaacttcggttataagatccctcaaagatgattaggttaataggttcgaggtggaagcatggtgacatgtggagctggacgaatactaatcg

SEQ ID NO: 4726 - DNA, 275 bp; double-stranded, linear
ttgaatttttgaaaaaaaaatgccgaaataaaagatgccaagatatccgccgggtaaaaaattaagtttccgaaaaaccaggtgttggtacccattgcatctggggtggcaaaagcatttgcagataaaattgtcatcagtggttacgatggtggtacagggcttcacccaaacgagtatcagcatgccggtgttcctgggagatggttagcagaacacatcaacataaactaatgctaagancggtaaagtagacancggtagtatactgaaat

SEQ ID NO: 4727 - DNA, 149 bp; double-stranded, linear
atcaatgaacaacacatacagatggtactgcgacgcctagagtaacaaaataagttttgtaactctatccaaagacatacagtcaatacaaaacattacgtatctttacaacagtaatcatgcattctatgatgcttctaactgaatna

SEQ ID NO: 4728 - DNA, 158 bp; double-stranded, linear
gcacgttattccattatcttaatggttatcttatcctcaactaaattggaggaatcactatgacaattaataaagaaccgttcttggcgcagcacaatgggcgctcactggcagacttttgtgatgctgacttaaagtaaactattagatattgngtg

SEQ ID NO: 4729 - DNA, 138 bp; double-stranded, linear
tcattgacatcgctggaataggtgtaaatcctgcgattcgatctggaccatatttttttattgtatacagtaattgtgctgcgattatctctgtaacgtctttccaatttgancgcacgtgccctcccatacctcggg

SEQ ID NO: 4730 - DNA, 187 bp; double-stranded, linear
taaagactataccattctatccaataataattggattcggatttgtctgaattcgtaaccgagaggcccctcgtccaaacagtgctctanctccaataatcatcacttgaggctagccctaaagtatttcggagagaaccagctatttccagttcgattggaatttctccgctaccctcagttcatc

SEQ ID NO: 4731 - DNA, 137 bp; double-stranded, linear
cgcatcctggggctgtagtcggtcccaagggttgggctgttcgccattaaagcggtacgaagctgggttcagaacgtcgtgagacagttcggttccctatccgtcgtgggcgtaggaaatttnagaggagctgtcct

SEQ ID NO: 4732 - DNA, 137 bp; double-stranded, linear
tcgttctcaatagaatgatttaaatcttcgatttctttatctaaatgactaccaattaaatctatttcttctattgttaaatcgctatctccatcttcttttatctctggtattatnttttcttcaactaagtcacg

SEQ ID NO: 4733 - DNA, 137 bp; double-stranded, linear; identical to SEQ ID NO: 4732

SEQ ID NO: 4734 - DNA, 153 bp; double-stranded, linear
aaaacataaatacaaaaatatagctattactataaaaaacagcagtaagcatatttccaaattgcaaattatcctactgctgttctttttgggcagtgggnacagcaaatgatattttcgacaaaatttatttcgtcgtcccaccccaacttg

SEQ ID NO: 4735 - DNA, 142 bp; double-stranded, linear
tagaaattacggacccaatttctctatgttggggcccatccccaacttgcacatnattgcaagctgacttttcgtcacttgctttgttggggccccgccaataagcgttgtagtgcctagtactttgattgatgtccaagtt

SEQ ID NO: 4736 - DNA, 137 bp; double-stranded, linear
atgttattcaaagtaaattgctttgcctgattttgcagactgataaatcgcttcaagaatttttgtaactaccattgcttgttccggtttcacaactggttcagtatcatttacaacngcatcaatccaagcttttg

SEQ ID NO: 4737 - DNA, 144 bp; double-stranded, linear
ggtcgtttagtatttggtcgtacaccgcaaaccaggtgcatctacccttggtcaggttgaagttcaggtaacactgaaatggaggaccgaaccgacttacgttgaaaantgagcggatgaactgagggtagcggagaaattcca

SEQ ID NO: 4738 - DNA, 157 bp; double-stranded, linear
gggtagctatgtgtggacgggataagtgctgaaacatctaagcatgaacccccctcaagatgagatttcccacttcggttataagatcctcaaagatgatgaggttaataggtcgaggtggaacatggtgacatgtnatctgcttttctaatcatac

SEQ ID NO: 4739 - DNA, 145 bp; double-stranded, linear
gctttatgtctaaaacgtcaaaataaaaagcaaacacaaagaaaaatggcttggcgaagtgaaaacggttgaatctgacgaaacgagaaaagaacgcaacgagtttagtagagctanatgagtaagtgagagccgaagagaggga

SEQ ID NO: 4740 - DNA, 234 bp; double-stranded, linear
tagtagcaccacccttagaccttcttgatttgacatcgttgttcttccttccttcggtctcgttactcatttagctctactaaactcgttgcgtcttttctcgtttcgtcagatcaaacgtttcacttcgccaagccatttttcttgtgtttattttatttgacgtttagacataaaaaagagacccacgttcaacttgccngcacgttctactctgcggantagtggctacca

SEQ ID NO: 4741 - DNA, 135 bp; double-stranded, linear
gcaagtctttttaaaggtaacactatcatttatgcaatacggcgcattaccagagttgcatggtcaaaatatattgttgtcatttgaagatggacgtgtacaaaaatgcgtgttacgtgatcatgatactgtcan

SEQ ID NO: 4742 - DNA, 145 bp; double-stranded, linear
accctggtacagttgaattcaggtaacactgaatggaggaccgaaccgacttacgttgaaaagtgagcggatgaactgagggtagcggagaaattccaatcgaacctggaganagctggttctctccgaaatagctttagggcta

SEQ ID NO: 4743 - DNA, 151 bp; double-stranded, linear
tgtcattcaagtagcgaaagaatttgcgcaaaacgctatcgatactgaaggggcgttcaatgattatcatgggtgcgggtattaaccattggtttaactcagatacgatttatngtgcaatcttaaacttagttatggtatgtggcgtcaa

SEQ ID NO: 4744 - DNA, 132 bp; double-stranded, linear
taaagctaaaaacacagctcataatatcaaaaaaggtgcagaagaaatggttgaagcggcaggcgataaaatcanagatggtgcatcttggttaggcgataaaatcggcgatgtgtgggattatgtacaaca

SEQ ID NO: 4745 - DNA, 132 bp; double-stranded, linear
cgtgcgctctaaccagctgagctataggcccattaatttgaatgaacaaacattcaaaactgaatacaatatgtcacgttattccgcatcttctgaagaagatgttccgnatatatccttagaaaggaggtg

SEQ ID NO: 4746 - DNA, 138 bp; double-stranded, linear
gtgatccgactcagatagcgatccgactcagatagcgactcagattcagacagcgattcagattcagacagcgattcagattcagatagcgattcagattccgacagtgactcagattccgacantgactcggattca

SEQ ID NO: 4747 - DNA, 185 bp; double-stranded, linear
cattattgtaaactgaacttttcgtcacttgctggtgnttggggaccccaccaacttggcacattattggtaagctgacttttcgtcacttactgtgttggggccccgccaacttgcattgtctgtagaaattgggaatccaatttctctatgttggggcccacaccccaactcgacattgcctg

SEQ ID NO: 4748 - DNA, 173 bp; double-stranded, linear
accgaatcccttcagaccggtacttgggtattcctccaaaattatatggaccttgacagtactcgaacctgacgtaccgaaacggttatgaagaccgttanctctaaccaactgagctaaaggatcctaaatataattttacaactaataaatagtggacggtggagggatcg

SEQ ID NO: 4749 - DNA, 212 bp; double-stranded, linear
acacaaggataaggcattgttggatgtgggatgctttaactgggcaagcgattggtcgtcctaaaacaggtacatatgccggctatctgacctagtcggtttagatattgcagtgtctgtaattaaagggcatgcaaccaagtanctgaggaaacaacttattttcatggtgtcaaaaattgntaaatacggtgtttgacaattgcgcacct

SEQ ID NO: 4750 - DNA, 140 bp; double-stranded, linear
aatctcaggttttaccaagcaaaaccgatgaataaagagttttaaataagcttgaattcataagaaataatcgctagtgttcgaaagacngcagcaagattaataacgcgtttaaatctttttataaaagaaaacgttta

SEQ ID NO: 4751 - DNA, 184 bp; double-stranded, linear
attcgtcagctccacatgtcaccatgcttccacctcgaacctattaacctcatcatctttgagggatcttataaccgaagttgggaaatctcatcttgaggggggttcatgctagatgcttcagactatcccgtccacacatgtaaccagnatgcgtggacgcatggaacagggatgtcatccg

SEQ ID NO: 4752 - DNA, 133 bp; double-stranded, linear
gggatcttccgcaatgggcgaaactgtacggagcaacgccgcgtgagtgatgaaggtcttcgatcgtaaaactctgttattagggaagaacatatgtgtaagtaactgtgcacatcttnacggtacctaatca

SEQ ID NO: 4753 - DNA, 162 bp; double-stranded, linear
gtatgctgtgtggcttgtcatgttcgggtttggtggcggacctgattattcctgcgntatacgctatggctggagcagtgtggccaaatggcggaagacaaacgtttaatgcgatctacttggcgcaaaatattggtgtggctgtcggtgctgcaatgggcg

SEQ ID NO: 4754 - DNA, 134 bp; double-stranded, linear
aattcgattcccttagtagcggcgacgaaaacgggaangagcccaaaccaacaagcttgctttgggggtttgtaggacactctatacggggttaacaaaggacgacattagacgaatcatcttgggaaagatga

SEQ ID NO: 4755 - DNA, 139 bp; double-stranded, linear
agagtgcgtaatagctcactagtcgagtgacactgcgccgaaaatgtaccggggctaaacatattaccgcaagctgtggattgtcctttggacatggctaggagagcgttctaagggcgttgaagcatgnatcgtaagg

SEQ ID NO: 4756 - DNA, 163 bp; double-stranded, linear
ggtcattggaaactggaaaacttgattgcagaagangaaattggaattccatgtggtacccgtgaaatgcgcagagatatggaggaacaccagtggccgaaagccactttctggtctgtaactggacgctggatgtgccaaacctgggggatcaaacaggtta

SEQ ID NO: 4757 - DNA, 160 bp; double-stranded, linear
catgaaactagataagtagtaaatatagattttaccaagcaaaaccgagtgaataaagagttttaaataagcttgaattcataagaaataatcgctagtgttcgaaagacatcacangattaataccgcgtttaatcttttataaaggaccgtaacttca

SEQ ID NO: 4758 - DNA, 177 bp; double-stranded, linear
tacatgggtttattgttgaagatgacgaaattgtagaaatttaatattctaaaaaggttggggacataaatccccctaaaaaaaccagcagtaagataattttcaattagaaaatatcttactgctgttctctatttataccanattactttcgtaattgttaaaattttaaaagga

SEQ ID NO: 4759 - DNA, 127 bp; double-stranded, linear
cggtgtgtacaagacccgggaacgtattcaccgtagcatgctgatctacgattactagcgattccagcttcatgtagtcgagttacagactacaatccgaactgagaacaacnttatgggatttgct

SEQ ID NO: 4760 - DNA, 145 bp; double-stranded, linear
gggcccctcgtcgggttaccgaattcagacaaactccgnaatgccaattaatttaacttgggagtcagaacatgggtgataagtccgtgttcgaaaggaaacagcccagaccaccagctaagtcccaaatatatgttaatgaaag

SEQ ID NO: 4761 - DNA, 228 bp; double-stranded, linear
taaacaaggcgcgttgggcctattcactgcggctcttctgggcgttaaccctaaagagcaccccttctcccgaagttacggggtcattttgccgagttccttaacgagattgctcgctcaccttagaattccatctgactacggtcgttgcgtacggcactatttcttcaagcttccgcattaacacaccaaaacagctcccaccaccactanatcgancaacactag

SEQ ID NO: 4762 - DNA, 130 bp; double-stranded, linear
tngccaaatcttagtagtcgcttggttcggttgtggtgcgacagctgtgaaatcatcactacgttgctcatcactcactgtctctccgcttccttgcgttgcaacagcttgaattgtatcagcagggttg

SEQ ID NO: 4763 - DNA, 151 bp; double-stranded, linear
caactcgtagtcagggtcgaaagacgggacttagtgatccggtggttccgtcatgggtagggccatcgtctcaacggtataaaagctaccccggggataacaggcttatctnccccaagagttcacatcgacggggaggtttggcacctcg

SEQ ID NO: 4764 - DNA, 128 bp; double-stranded, linear
accccaacttgcattgnctgtagaaattgggaatccaatttctctttgttggggccccgccggcaaggttgactagaattgaccaaaagcttgttacaagcgcattttcgttcagtcaactactgcca

SEQ ID NO: 4765 - DNA, 135 bp; double-stranded, linear
aatacagccccagagcgatgagccgacatcgaggtgccaaacctccccgtcgatgtgaactcttgggggagataagcctgttatccccggggtagcttttatccgttgagcggatggccctttccatgtggnaac

SEQ ID NO: 4766 - DNA, 126 bp; double-stranded, linear
gattctcacccgtctttcgctactcacaccggcattctcacttctaagcgctccacatgtccttacgatcatgcttcaacgcccttagaacnctctcctaccattgtccaaaggacaatccacagc

SEQ ID NO: 4767 - DNA, 130 bp; double-stranded, linear
ttaatagttttataagagaggtgtttgatcttgagctaaccacntcattcgagtactgtcatgaagtaatttctctattctacgaccagaaaatacagatggggtatatgcatataagatgatttttaac

SEQ ID NO: 4768 - DNA, 142 bp; double-stranded, linear
gttaaccctaaagagcaccccttataccgaagttacggggtcattttgccgagttccttaangcgcgttcgatcgctcaccttaggaattctcatcttgactacctgtgtcggtttgcggtagggcacctattttcctatct

SEQ ID NO: 4769 - DNA, 136 bp; double-stranded, linear
ccttgggaccgactacagccccaggatgcgatgagccgacatcgaggtgccaaacctccccgtcgatgtgaactcttgngtggagataagcctgttatccccggggtgagctttgtatccgttgagcgatggccct

SEQ ID NO: 4770 - DNA, 145 bp; double-stranded, linear
ctaaaagttgtattttaaaaatagttctttaaattatatacccaccacatttggtggagaaccgttaaacaatgcatagtttgcttaacttccaatattgactcatcattacaattgacatagagctattaagcgtngccatgag

SEQ ID NO: 4771 - DNA, 128 bp; double-stranded, linear
tcgagtgacactgtcgccgaaaatgtaccggggctaaacatattaccgaagctgtggattgtgcctttggaaatggtgaggngagcgttctaagggcgttggaagcatgatcgtaaggacatgtggga

SEQ ID NO: 4772 - DNA, 126 bp; double-stranded, linear
gggcagatgttcctgcagtcatagtgccgtcaactttaaatactgtacgtaatttggctaatgcctccatcgtggntgtcagggcgtataaattcatcttgggtcaaagatatttggtgtgtactt

SEQ ID NO: 4773 - DNA, 126 bp; double-stranded, linear
gtcttttctcgtttcgttcagattcaaacgttttcacttcgccaagccatttttctttgtgtttactttttattttgacgttttaggataaaaaaaaganaccttgcggtctcaatgcggctcatc

SEQ ID NO: 4774 - DNA, 124 bp; double-stranded, linear
atttcaatatcaggctacagtaaagctccacggggtctttccgtcctgtcgcgggtaacctgcatcttnacaggtactatgatttcaccgagtctctcgttgagacagtgcccaaatcgttacg

SEQ ID NO: 4775 - DNA, 124 bp; double-stranded, linear
accaagtgagccggaaacaccaacgccaccaacaccagaagtaccaagtgagccggaaacaccaacaccaccgacaccagaagtgccgagtganccagaaactccaacaccgccaacaccagag

SEQ ID NO: 4776 - DNA, 135 bp; double-stranded, linear
cccgctagtctccaccatttattttttacacgatgaacattgaaaactnaatacaatatgcaacgttaattccaaaaaacgtaactataagttacaaacattatttagtatttatgagctaatcaaacatcataa

SEQ ID NO: 4777 - DNA, 144 bp; double-stranded, linear
agtgcagaagaggaaagtggaatanccccaacatagcggtgaaatgcgcagagatatggaggaacaccagtggcgaaggcgactttctggtctgtaactggacgctggatgtgcgaaacgttgggggttcaaacaggatttaga

SEQ ID NO: 4778 - DNA, 123 bp; double-stranded, linear
aatttttgatgacgggtcccttcctagggtgccgtctcagccaccccaaccggcacattgttgtaagctgactatatgtcnttcatgtgttggggcccctgtcttcgactggcactgctccct

SEQ ID NO: 4779 - DNA, 127 bp; double-stranded, linear
gcgcattaactatcgcgatattaatcgctattctatatcgtcactttagaggatatcctgaacaatatagctcaggtattacgttttcatctaaatatttattaagatttgcaatcatcctanatgg

SEQ ID NO: 4780 - DNA, 127 bp; double-stranded, linear
ggtaatatgtttagccccggtacattttcggcgcantgtcctcgactagtgagctattacgcactctttaaatgatggctgcttctaagccaacatcctagttgtctgggcaacgtcacatcctttt

SEQ ID NO: 4781 - DNA, 129 bp; double-stranded, linear
acacngggtgagaatttgtcgctatttgtaaattgtatcctggcttaagttggccaaagtgtcttatttttttaaagtatttaaaagtaaaattacatgttaatacgtagtattaaatggcgagactcc

SEQ ID NO: 4782 - DNA, 136 bp; double-stranded, linear
ctcattcccgttgcattttatcttctgcaacaacaacatttcgtctttatcgtcttccatagtagtaggattttctactacttgaccattcataatctgttgcatttcatgtttgntttggtcagatttaggacca

SEQ ID NO: 4783 - DNA, 119 bp; double-stranded, linear
catcaacatcggcgcattaaaagatggacgttttgatgatgtacaacaagacattgaagcagtggttaaagctgcgaaaggtcacacagtaaaagtgattattgngacggtattgttgg

SEQ ID NO: 4784 - DNA, 127 bp; double-stranded, linear
atcactaatccattgtggtaagtctccaagttcgtcttccatacgtgttttaacctgcgtnatcccattgcatcccataattgtgaatggaccaagtttccagttgaacccccagacaagcgcacgg

SEQ ID NO: 4785 - DNA, 119 bp; double-stranded, linear
acaccggcatgctgaatactcgttttgggtgaagcccctgnaccaccatcgtaaccactgatgacaattttatctgcaaatgcttttgccaccccagatgcaatggtaccaacacctgt

SEQ ID NO: 4786 - DNA, 137 bp; double-stranded, linear
ctttctaaacccgncaccactttatcgtggtggggagacagtgttcaggcgggccagtttgactggggccggtcgctcctaaaagtaacgaggcgctcaaagttccctcagaatgttggaaatcattcatagagtgt

SEQ ID NO: 4787 - DNA, 119 bp; double-stranded, linear
gtttttaacactgttaccgttttcatcttttaatgttaccgttacgccaganatacctttttcatcttggtcttggataccatttttatttgtatcttcccagacatagtcacctaagt

SEQ ID NO: 4788 - DNA, 141 bp; double-stranded, linear
catgcttccacctcgaacctattaacctncatcatctttgagggatcttataaccgcagttgggaaatctcatcttgtaggggggcttcatgcttcagatgctttgcagcacttagcccggccacacatagctacccagct

SEQ ID NO: 4789 - DNA, 139 bp; double-stranded, linear
ctgggttcagaacgtctaagcagttcggtccctatccgtcgtgggcgtaagaaatttgagaggagctgtccttagtacgagaagaccgggatggactacctctngtgtaccaattgtcgtgccaacgcatagctgggta

SEQ ID NO: 4790 - DNA, 129 bp; double-stranded, linear
cattatttagtatttatgagctaatcaaacancataatttttatggagagtttgatcctggctcaggatgagcgctggcggcgtgcctaatacatgcaagtcgagcgaacggacgagatgcttgcttcg

SEQ ID NO: 4791 - DNA, 120 bp; double-stranded, linear
gggtgctctttagggttaacgcccagaagagccgcagtgcaataggcccaagcgactgtttatcaaaancacaggtctctgctaaaccgtaaggtgatgtataggggctgacggcttccc

SEQ ID NO: 4792 - DNA, 123 bp; double-stranded, linear
caaattctttcgctacttgaatgacaacactttgttttacgcctgaaatggcttcttgccaagcaggtgtatattttgattctgcatcgtcgtatccttttgatctaattatgatcaaaccgn

SEQ ID NO: 4793 - DNA, 130 bp; double-stranded, linear
ttctaagatatattcggaacatcttcttcagaaatcggaataacgtgacatattgtattcagttttgaatgtttgttcattcaaattaatgggcctatagctcagctggttagagcgcacncctgataac

SEQ ID NO: 4794 - DNA, 115 bp; double-stranded, linear
cacagccacaagtgattaaaggcttacccaatgatcctgaaatgacgatagagtcagtattaactcatttttcaatagatcaggaagactaccaagcttatgtngaaggacatct

SEQ ID NO: 4795 - DNA, 224 bp; double-stranded, linear
nttaaaaaaaattcccaattttttttggggggttgggaatttaaaaatttggtttttaacccaaaggcccttttcccaaaaatttaaattcccttaaaaatttaaaatttgggaatttttttttnggcccaaaattttttccctttttttaaaggccccaatttttaatttaacccttaaaacccccaaaccttttttccttttttaaaatttttttaaatgga

SEQ ID NO: 4796 - DNA, 120 bp; double-stranded, linear
tcgcgtaccgctttaatgggcgaacagcaagaccttgggcaccgactacagccccangatgcgatgagccgacatcgaggtgccaaacctccccgtcgatgtgaactcttgggggcagat

SEQ ID NO: 4797 - DNA, 125 bp; double-stranded, linear
aattcgattcccttagtagcggcgagcgaaacgtgaagagccccanaccaacaagcttggctgttgtggttgtaggacactctataacgggagttacaaaggaccgacattagacgaatcatctg

SEQ ID NO: 4798 - DNA, 113 bp; double-stranded, linear
caaaataatgactcctacgggnctcgaacccgtgttaccgccgtgaaagggcggtgtcttaaccgcttgaccaaggagccatggctccacaggtaggactcgaacctacgacc

SEQ ID NO: 4799 - DNA, 116 bp; double-stranded, linear
ccggtgggaggtaaccttttaggagctagccgtcgnaggtgggacaaatgattggggtgaagtcgtaacaaggtagccgtatcggaaggtgcggctggatcacctcctttctaagg

SEQ ID NO: 4800 - DNA, 112 bp; double-stranded, linear
aggacttaaaagcagaattaattgaccaagtcggttacttcattgagccagaagatttattcagtgcgatgattcgtgaaattgaaacgcaagatttcgatatcgancacct

SEQ ID NO: 4801 - DNA, 110 bp; double-stranded, linear
ataggataggcgacgtgcgattggattgcacgtctaagcantaaggctgagtattaggaaatccggtactcgttaaggctgactgtgatggggagaaacattgtgtcttc

SEQ ID NO: 4802 - DNA, 237 bp; double-stranded, linear
gaaccaagttgttattgaaaantcgttcgtaaagttacggtacgcccaccgtgagtgcttttacttctatatcagcacctactgtatctttcattaatttaacgtcttctgcagtcgcaccgccacctgcaaaacctgttgaattttacgagtccgcaccgcgctttgtaatcatncttacattctctgtcacaacgccataccttcgggactgactcacagctcagcggaacacaa

SEQ ID NO: 4803 - DNA, 114 bp; double-stranded, linear
cttgaacccccaacctactgattacaagtcagttgctctaccaattgagctaagccgggcaatatgtaagaataaatggtggagaattgacgggttcgaaccgccgancctctg

SEQ ID NO: 4804 - DNA, 113 bp; double-stranded, linear
ggatcaaacaggattagataccctggntagtccacgccgttaaacgcatgagtgctaagtgttaggggtttccgccccttagtgctgcagctaacgcattaagcactccgcct

SEQ ID NO: 4805 - DNA, 108 bp; double-stranded, linear
taccagggtatctaatcctgtttgatccccacgctttcgcgcatcagcgtcngttacagaccaggaaagtcgccttcgccactggtgttcctccatatctctgcgcat

SEQ ID NO: 4806 - DNA, 115 bp; double-stranded, linear
tttcagcacttatcccgtccacacatagtctacccaggctatgccgttggcacgacaactggtacaccagaggtatgtccatcccggtcctctcgtactaagganagctcctctc

SEQ ID NO: 4807 - DNA, 167 bp; double-stranded, linear
cagccacataacataactaagtttaagattgaacgataaatcgtatctgagttaaaccaatggttaatacccgcacccatgataatcattgaacgccttcagtatcgtaggtttggaattttcgtcttatgcacattnttcgctgatgtctgcagagtttttgttga

SEQ ID NO: 4808 - DNA, 118 bp; double-stranded, linear
tgcttacatcattagctaattgagcacatgttgccattgcttgcagctaaattaccttgcatcattgctagcttttcttgtattaactgatanttactaattggtttgccgaattgct

SEQ ID NO: 4809 - DNA, 150 bp; double-stranded, linear
ttgaggtagcctaaagctatttcggagagaccagctatctccaggttcgattggaatttctccnatacctcagttcatccgctcactttcaacgtaagtcggttcggtcctcatcagtggtacctgacttcaactgaccagggtagacac

SEQ ID NO: 4810 - DNA, 107 bp; double-stranded, linear
aagaaggcgacgatacattatcacctggtgtaacaattagtacgtgtatatatcgttcanaaacgtaaattcatgttggtgataagatgtgtggtcgacatggtaca

SEQ ID NO: 4811 - DNA, 117 bp; double-stranded, linear
agagtgnattaggttatgaaggtgggcaaaatagggtaaccagtcattcgaggaagacacagaagaagacaaacctaaatatgaaccaaggtggcatatcgtagatatcgatttcca

SEQ ID NO: 4812 - DNA, 123 bp; double-stranded, linear
cttttatccgttgaacgatggcccttccatgcggaaccacccgatnactaaatccgtctttcgaccctgctcgacttgtaagtctcgcaatcaagtcccttatgcctttacactctatgaatg

SEQ ID NO: 4813 - DNA, 106 bp; double-stranded, linear
taacccgagagggtcccctngtccaaacagtgctctacctccaatatcatcacttgaggctagccctaaagctatttcggagagaaccagctatctccaggttcga

SEQ ID NO: 4814 - DNA, 112 bp; double-stranded, linear
ctattgctttagatgcatatgaatcattgantgacgcgatgccgatgatttctgaacacggaatcgcgaacgttggccaactgccaacgattggcgtgggaatcatccagtg

SEQ ID NO: 4815 - DNA, 125 bp; double-stranded, linear
acgtggagagcatgtccgttcaagcagaggggcggcggttgaacccgtcattctgcaccatttattcttacatattgccggnctagctcaattggtagagcaactgaccttgtaatcagtaggtt

SEQ ID NO: 4816 - DNA, 104 bp; double-stranded, linear
gtgctggcgcagttgcgatggttattgcacataatccaagcatggcattaaatgaagatgctgttgcttacactgaagacgtttatgntttctggcgtccaact

SEQ ID NO: 4817 - DNA, 117 bp; double-stranded, linear
gtcgggtaagttccggcccgcacgaaaggcgtaacgatttgggcactgtctcaacgngagactcggtgaaatcatagtacctgtgaagatgcaggttacccgcggcagggcggaaag

SEQ ID NO: 4818 - DNA, 121 bp; double-stranded, linear
ctaaggaaccttgtcttggacttgtgcacaatcgctttcttctttcctctccttcggctctcgcttactcatttagctctactaaactcgttgacgctcttttctcgnttcgtcagattca

SEQ ID NO: 4819 - DNA, 118 bp; double-stranded, linear
tcagttcggtattgtgagtctgcaactcgactgacatgaagctggaatcgctagtaatcgtagatcagcatgctacggtgaatacgttcccgggtcttgtacacaacgcccgtnaaga

SEQ ID NO: 4820 - DNA, 104 bp; double-stranded, linear
caaacagtgctctacctacaataatcatcacttgaggctagccctaaagctatttcggagagaaccagctatctncaggttcgattggaatttctccgctaccc

SEQ ID NO: 4821 - DNA, 165 bp; double-stranded, linear
tcgtagtggtttccaaccaagtttttataagtcaaacgctcacatacggcttcgttttcattattttaaatgctcatttacatagtnaactcgctttaaaataatttaactcatgtcgctaacgttttcttttataaaagtttaacggttttatctgtggtgtct

SEQ ID NO: 4822 - DNA, 113 bp; double-stranded, linear
gagtttgatccgggctcaggatgaacgctggcggcgtgcctaatacatggcaatcgagcgaacggacgagaagcttgcttcnctgaggtagcggcggacgggtgagtaacacg

SEQ ID NO: 4823 - DNA, 106 bp; double-stranded, linear
ccggcaacgttctactctagcggaacgtaagttggctaccatcgacgctaagaacctttctttganttgtgacaatcgcttgcttctttcctcttcttcggctctc

SEQ ID NO: 4824 - DNA, 108 bp; double-stranded, linear
taaacggcggccgtaactataacggtcctaaggtagcgaaattccttgtcgggtaagttccgacccgcacgaaaggcgtaacgatttgggcactgtctcaactagagn

SEQ ID NO: 4825 - DNA, 116 bp; double-stranded, linear
tctagtgaccgatagtgaaccagtaccgtgaggataaggtgaaaagcaccccggaagtagntgtaaatagaacctgaaaccgtgtgcttacaagtagtcagagcccggtaatgggt

SEQ ID NO: 4826 - DNA, 160 bp; double-stranded, linear
ataatattgtaaattaatccattgatgccacaagtgccggaccagaaatgatggtatttaataatgtgccatctttatctttacgccaatcataattggtaaaaattcccccttctaataatccttgtattgcgtgtcatanagtctttgctccttgcac

SEQ ID NO: 4827 - DNA, 115 bp; double-stranded, linear
cgcattgagaccgcaagctcttttttttatgtctaaaacgtcaaaataaaaagtaaacacaaagaaaatggttggccnagtgaaaacgtttgaatctgacgaaacgagaaagagc

SEQ ID NO: 4828 - DNA, 103 bp; double-stranded, linear
ccaaaatagccttcataatccaaaaacaggctcctttgactatagattttcgtttctggttcagaaagcttttgattaactttaaagtatncccaattataat

SEQ ID NO: 4829 - DNA, 111 bp; double-stranded, linear
ggaccgaactgtctcacgacgttctnaacccatctcgcgtaccgctttaatgggcgaacagccaacccttgggaccgactacagccccatgatgcgatgagccgacatcga

SEQ ID NO: 4830 - DNA, 105 bp; double-stranded, linear
gttgttggggccccgccggcaaggttgactagaattgagaaaagcttgttacaacgctattttcgttcagtcaacnactgccaatataactttgtagagcattga

SEQ ID NO: 4831 - DNA, 102 bp; double-stranded, linear
acattgagtcttcgagtcgttgcatttcacactgccgngaaaagcctctagatagaaaataggtgcccgtaccgcaaaccgacacaggtagtcaagatgaga

SEQ ID NO: 4832 - DNA, 107 bp; double-stranded, linear
ttntagaatgaaccggcgagttacgatttgatgcaaggttaagcagtaaatgtggagccgtagcgataaggaggtctgaatagggcgtttagtatttggtcgtagcc

SEQ ID NO: 4833 - DNA, 144 bp; double-stranded, linear
tgcaactaatgaaaagtagagttccggggagttaaaaccagtgactgttgaccttgttgtctccattggaatgtactacctgatgcaagataattatcatcactttgttgacgtgcttnattttcagcatcaatttgatcaatc

SEQ ID NO: 4834 - DNA, 108 bp; double-stranded, linear
ggctcagatgnacgctggcggcgtgcctaatacatgcaagtcgagcgaacggcaccagaagcttgcttctctggatgttagcggcggacgggtgtagtaacacgtggg

SEQ ID NO: 4835 - DNA, 102 bp; double-stranded, linear
gacaatggtaggngagcgttctaagggcgttgaagcatgatcgtaaggacatgtggagcgcttagaagtgagaatgccggtgtgagtagcgaaagacgcagt

SEQ ID NO: 4836 - DNA, 109 bp; double-stranded, linear
ttgcagactacaatccggaactggagtaacaactttatgggatttgncttgacctcgcggtttcgctggccctttggtattgtccattgtagcacgtgtgtagcccaaa

SEQ ID NO: 4837 - DNA, 103 bp; double-stranded, linear
ctccacgtaagctagcgctcacgtttcaaaggctcctacctatcctggtacaagctgtgccggaatttcaatttgcangctacagtaaagctccacgggggtc

SEQ ID NO: 4838 - DNA, 121 bp; double-stranded, linear
tcaaacactcncatactgctttattttcataaacaatatcactttaaccaaaaaatatttgaatgttaaataaacattcaaaactgaatacaatatgtcacgttattccacatcttctgga

SEQ ID NO: 4839 - DNA, 104 bp; double-stranded, linear
aaaccatgaattaagaatccagaaacaggagatgtagttagaccaccggtcgattagcgtaccaaaatatggacctgtaaaaggagactcgattgtaganaaag

SEQ ID NO: 4840 - DNA, 127 bp; double-stranded, linear
ccgtggagtttatgtagcctgatattgaattcggcacagttgtacaggtaggtaggagccttgaaacgtgagcgctattagtgnaggcgtggtgggtactaccctagctgtgttggctttctaaccc

SEQ ID NO: 4841 - DNA, 125 bp; double-stranded, linear
catcccaccccgggcaaggttgactagaattggaaaaaaacttggttacaacgttattttcattcagtcaactactgccaatataatattgnaaactataggacatttattagtgtttcagttct

SEQ ID NO: 4842 - DNA, 108 bp; double-stranded, linear
tggtacggcatctcacccgtctttcgctactcacaccggcattctcacttctangcgctccacatgatccttacgatcatgacttcaacgcccttagaacgctcgtcc

SEQ ID NO: 4843 - DNA, 108 bp; double-stranded, linear
taatgaaggtcttcggatcgtaaaactctgttattaagnaggaacatgtgtgtaagtagctgtgcacatcttgacggtacctaatcagaaagccacggctaactacgt

SEQ ID NO: 4844 - DNA, 117 bp; double-stranded, linear
cggtctcaatgcggctcatcgcatccattttttgacctgggcaacgttctactctagcggaacctaagttgggctaccatcgacgnctaagaacctttcttgacttgtgtacaatcg

SEQ ID NO: 4845 - DNA, 108 bp; double-stranded, linear
gactgtttatcaaaaacacaggtctctgctaaaccgtaagtgatgtatagggggctgacgcctgnccgggttctggtaaggttaagaggagtggttagcttctgcgaa

SEQ ID NO: 4846 - DNA, 118 bp; double-stranded, linear
caatatttgaagcgattggcttgtctcatgatgtgattgatcgttattttactgggacacagtctaagttatctggtatttcgattgatcaaattntgcctgaaaaagacgcacaagt

SEQ ID NO: 4847 - DNA, 104 bp; double-stranded, linear
gatccccggacggagtgcttaatgcgttactgacagcactaaggggcggaaaccccctaacacntagcactcatcgtttacggcgtggactaccagggtatcta

SEQ ID NO: 4848 - DNA, 137 bp; double-stranded, linear
ctggcgattatgctctgtaacgtgctttccaatttggaacgcacgtgnccctgcccatacctacgggacttgacttatattgtttggctttgtacgtcatttcaacaatagacgcccatgccagcaacgcgattacc

SEQ ID NO: 4849 - DNA, 116 bp; double-stranded, linear
gtttaggctcatcttaagatgttaggtccactcggtttacaccatattttttacttaccgttttggcagacggcacttggtggtactttagaagtcaaagacangggggggggggg

SEQ ID NO: 4850 - DNA, 125 bp; double-stranded, linear
tcctttcgtgacgggctcggtaacttacccgacaaggtaatttcgctaccttaggnaccgttatagttacggtccgccgtttactggggcttcgattcgtatcttcgcagctatatctcactcct

SEQ ID NO: 4851 - DNA, 96 bp; double-stranded, linear
aagttgtattttaaaaatagttctttaaattatatacccaccacatttggtgggagaacctaaaaaaaagcactttccccaaaaatgggaaagtgc

SEQ ID NO: 4852 - DNA, 100 bp; double-stranded, linear
accgtgtgcttacaagtagtcagagcccgttaatgggtgatggcgtgccttttgtagnatgaaccggcgagttcacgatttagatgcaaggttgaagcag

SEQ ID NO: 4853 - DNA, 101 bp; double-stranded, linear
ccgacagcgtagncgatggataacaggttgatattcctggtaccacctataatcgttttaatcgatgggggacccataggatagcgaacctgcgattggat

SEQ ID NO: 4854 - DNA, 102 bp; double-stranded, linear
ggacatctcctaaggctaaatactctctagtgaccgtagtgaaccagaccgtgaggaaaggtgaaanaccccggaggggagtgaatagacctgaaaccgtgt

SEQ ID NO: 4855 - DNA, 104 bp; double-stranded, linear
ataaccgcaattggcgaaatctcatcttgaggggggcttcatgcttagatgctttcagcacttatcccgtccacacatanctacccagctatgccgttggcacg

SEQ ID NO: 4856 - DNA, 138 bp; double-stranded, linear
ctactgtcttcattctttcagttcttttttacgggtctgttttctaatttgagcacatcttcgattctttatcaaatgactaccaattaaatctattcctctntggtaaatcgctaactccatctccttaacccggta

SEQ ID NO: 4857 - DNA, 100 bp; double-stranded, linear
tcaaacgnttgtcatctattaaagaagtaggtctagatatatcacgtacgtaatgtgtaatggatggcgctattgctttaggtcatccattaggtgctac

SEQ ID NO: 4858 - DNA, 106 bp; double-stranded, linear
cttaaccttgcagcaccgtgcaggcgtcaccctatacatcancttacggtttagcagagacctgtgtgtttgataaacagtcggttgggcctattcactgcggctt

SEQ ID NO: 4859 - DNA, 152 bp; double-stranded, linear
gtaactcgccggttcattctacaaaagggcacgccaatcacccattaacgggctcctgaactacttgttaagcaacacggtttccagggttctatttccacttcccctttccggggtngctttttcaacctttttccccctccacggttact

SEQ ID NO: 4860 - DNA, 100 bp; double-stranded, linear
gcccgtaccgcaaaccgacacaggtagtcaagatgangaattctaaggtgagcgagcgaactctcgttaaggaactcggcaaactgaccccgtcacttcg

SEQ ID NO: 4861 - DNA, 104 bp; double-stranded, linear
caggtaacactgaatggaggaccgaaccgacttacgttaaaaagtaagcggatgaactaaaggtagcngagaaattccaatcgaacctggagatagctggttct

SEQ ID NO: 4862 - DNA, 87 bp; double-stranded, linear
ttacttatctagttttcaatgtacaaataatggtggagactagcgggatcgaaccgctgacctcctgcgtgcaaagcaggcgctctg

SEQ ID NO: 4863 - DNA, 105 bp; double-stranded, linear
accgtttgatttcttatctaattcaagcttatttaaaactctttattcactcggttttggcttggtaaaatctatattttacttacttatctanttttcaatgta

SEQ ID NO: 4864 - DNA, 129 bp; double-stranded, linear
agggaatcgaattttctttctcttcctccggggtactaagatgtttcagttctccgggtgtgccttgctggatgatgctatgatattgcacatatcgaatcaacagtggtgcatgaacctgcantggct

SEQ ID NO: 4865 - DNA, 100 bp; double-stranded, linear
aaaccgcaaggtcaagcaaatcccataaagttgttctcagttcggattgtagtctgcaactcgactacntgaagctggaaatcgctataaatcgtagatc

SEQ ID NO: 4866 - DNA, 115 bp; double-stranded, linear
gtgataagattagcagaaaatggatggtgttaagagagttaattggtttggnggtatgcttatttttaatggcattgtgtacgagagcattagagtttgtacttgtgaggttatt

SEQ ID NO: 4867 - DNA, 90 bp; double-stranded, linear
acaccactcctcattaaccttccagcaccgcagcaggcgtcacccctatacatcaccttacggtttagcagagacctgtgtttttgataa

SEQ ID NO: 4868 - DNA, 87 bp; double-stranded, linear
cacgaacgattgtcttgcgtgcggggattatctgacacggtaccggtcaaacagtgaatcgctactgctcatcagggattacaaacc

SEQ ID NO: 4869 - DNA, 165 bp; double-stranded, linear
gagcaccccttctcccgaagttacggggtcattttgccgagttccttaacgagagtcgctcgctcaccttagaatctatttacactggtgttggtaggcacttttttcaagcttccgattaacacatgaaaagcttccaaagtactaggacgttcaatacatgta

SEQ ID NO: 4870 - DNA, 111 bp; double-stranded, linear
aatatcatttataacattaagtaataactttttttatcttgtccattttatttttnaaccaaaatttgattaaaaaactgcctggcaacgttctactctagcggaactaag

SEQ ID NO: 4871 - DNA, 84 bp; double-stranded, linear
tagcagagacctgtgttttttgataaacagtcgcttgggcctattcactgcggctcttctgggcgttaaccctaaagagcaccc

SEQ ID NO: 4872 - DNA, 101 bp; double-stranded, linear
acagtaaagctccacgggtctttccgtcctgtcgcgggtaactgcatcttcacaggtactatgatttcaccgatctctcnatgaacagtgccaaatcgtac

SEQ ID NO: 4873 - DNA, 87 bp; double-stranded, linear
gacaggcgtaggcgatggataacaggttgtattcctgtaccacctatgatcgttttaatcgatggggggaagcataggataggcgaa

SEQ ID NO: 4874 - DNA, 81 bp; double-stranded, linear
gggagagcgcctgctttgcacgcaggaggtcagcggttcgatcccgctagtctccaccattatttgtacattgaaaactag

SEQ ID NO: 4875 - DNA, 81 bp; double-stranded, linear
tatgtttcgaaatatctttatcactctaaaatgatatacaagaaatccaagaaaaataagcgaactgaataaataaagatt

SEQ ID NO: 4876 - DNA, 87 bp; double-stranded, linear
aacgcgttaaatctttttataaaagacgtaacttcatgttaacgttgcttataaaaatggtggaacatagattaagttattaagggc

SEQ ID NO: 4877 - DNA, 101 bp; double-stranded, linear
acaacggataaaagctaccccggggataacaggcttatctcccccaagagttcacatcgacggggaggtttgncctcaatgtggctcatcggatcttgggg

SEQ ID NO: 4878 - DNA, 79 bp; double-stranded, linear
atttattaggtgtacaaatgaccaccgcatcaacaagtttaaacagctcgctaggtgtctcaactgcatgaggtatatt

SEQ ID NO: 4879 - DNA, 83 bp; double-stranded, linear
acatcgtttcaatgggtcgctaacgctgctaggacattataacagacgtgtacaaaaagaaaattggtatggtaattgtggca

SEQ ID NO: 4880 - DNA, 84 bp; double-stranded, linear
cttcatcctgatccagatcaaactctccataaaaattatgatgtttgattagctcataaatactaaataattttgtaactaata

SEQ ID NO: 4881 - DNA, 80 bp; double-stranded, linear
ttgtgcagttgcatcgccattgatcaataacacgttgagctgcagttatttcagtttctgcttcacgcttcttcgcatta

SEQ ID NO: 4882 - DNA, 86 bp; double-stranded, linear
tctgatgtgaaagcccacggctcaaccgtggagggtcattggaaactggaaaacttgagtgcagaagaggaaagtgggttccatgt

SEQ ID NO: 4883 - DNA, 127 bp; double-stranded, linear
tgatcgcatatctacgcaacatcggcataagtntgatgacaaacaagcttccatgacaaaagtaatggacgaatatcgcatttggggaaagtcctctaaaaatgccttttgaaggaacgtcggttaa

SEQ ID NO: 4884 - DNA, 78 bp; double-stranded, linear
agtaggaatcgaacccacaccaaagttttggagacctctattctaccttgaactatgcccctattaaaaataataaat

SEQ ID NO: 4885 - DNA, 84 bp; double-stranded, linear
ctcactattcgagtgacactgcgccgaaaatgtaccggggctaaacatattaccgaagctgtggattgtcctttggaaatgggt

SEQ ID NO: 4886 - DNA, 117 bp; double-stranded, linear
ggtatctgttcactcttccggtggtgcagttgcgaccaacaatgggttggagattggatttcatccttctcaattaatcgttgccgtacttttcaantggtaccccatccaaaaggg

SEQ ID NO: 4887 - DNA, 80 bp; double-stranded, linear
cggatctgggaggaaatctcctaaggctaaatactctctagtgaccgatagtgaaccagtaccgtgaggaaaggtgaaaa

SEQ ID NO: 4888 - DNA, 77 bp; double-stranded, linear
aatatgcaagcacatggtgaatatgacgaggttgcaacttcaacggcgaagatgatggaaggccttacgtttgcgtg

SEQ ID NO: 4889 - DNA, 76 bp; double-stranded, linear
tcttctgggcgttaaccctaaagagcaccccttctcccgagttacggggtcttttgccgagttccttaacgagagt

SEQ ID NO: 4890 - DNA, 117 bp; double-stranded, linear
gtgggggccccaacataggagctgattttctgtcagcttaccatnatgtggcaagttggcgggggcccccaaaccaaggagctggctttctgtcactttaccattaatgtggcaagt

SEQ ID NO: 4891 - DNA, 109 bp; double-stranded, linear
ttaatccncctgcatatgatgactttgttgaaccgtcattgcatactttcaacatgaatacgctgaacaccttcacttactgcatatcttagttcctcggtctgtctta

SEQ ID NO: 4892 - DNA, 88 bp; double-stranded, linear
ctcttaaccttgcagcaccgggcaggcgtcagcccgtatacatcaccttacggtttgcagagaccgtgtgtttttgagaaacaggtgc

SEQ ID NO: 4893 - DNA, 102 bp; double-stranded, linear
tagcgaatgagataaacgcggcggactgtaaatccgctccttcgggttcggcagttcgaatctgcccccctccatttattattttnaaaaaaagcatagttc

SEQ ID NO: 4894 - DNA, 78 bp; double-stranded, linear
cgagcgattccgactcagacaatgactcggaattcagataacgaatctgactcagacagtgactcagattccgacagt

SEQ ID NO: 4895 - DNA, 141 bp; double-stranded, linear
actagatagtaagtaaaagtgattttgcttccgaaacatttatttgattagtcttcgtcgttagtattcgcactcacatgtcacatgcttcactcgacctattacctcacacttggggacttataccgagtnggaatctca

SEQ ID NO: 4896 - DNA, 80 bp; double-stranded, linear
gttcggatttaatttgattcatttgttgcgtaatttcagaagccattttatgaaaagagtgatttaattcataaatttct

SEQ ID NO: 4897 - DNA, 73 bp; double-stranded, linear
ggtatggctggcgctttacgtgccacattagattatgtcactgagcgtaagaagttcggcaaaccaattagta

SEQ ID NO: 4898 - DNA, 71 bp; double-stranded, linear
gtgccgaggaccggaatcgaaccggtacggtgatcactcaccgcaggattttaagtcctgtgcgtctgcca

SEQ ID NO: 4899 - DNA, 116 bp; double-stranded, linear
agccgctggattccacggtgtaagcagtaaggctgagtattaggcaaatccggtactcgttaaggctggagctgtngatggggagaagacatgtgtgcttacgtagtgcgtggttt

SEQ ID NO: 4900 - DNA, 113 bp; double-stranded, linear
ttccggcccctggcggtntcctaggagttccacggaaccccaggattttgtaggaccccccgggcagagtccccttcgactaagaaaatctcacattcttcagggacttttac

SEQ ID NO: 4901 - DNA, 78 bp; double-stranded, linear
acttaatggattgattaagtagtgggttcttaacattaggcctcagctaatgtggtacttaaaaatagggaatacatg

SEQ ID NO: 4902 - DNA, 84 bp; double-stranded, linear
atgggacatggtgtgcctccttgctatagtcaccagacatatgaatgtaatttatacattcaaaactagatagtaagtaaaagt

SEQ ID NO: 4903 - DNA, 70 bp; double-stranded, linear
ttgtcgggtaagttccgacccgcacgaaaggcgtaacgattttggcactgtctcaacgagagactcggtg

SEQ ID NO: 4904 - DNA, 151 bp; double-stranded, linear
taagttggctaccatcgacgctaagaacctttcttgacttgtgacaatcgcttgcttctttcctcttcttggctctgcttctatttgcctctaatgtggctttttgttgtaataagttatgcgcttcggtgttatngtgaaaaagcggtca

SEQ ID NO: 4905 - DNA, 75 bp; double-stranded, linear
tgacttgtaggcgctggtgggatactaccctagctgtgttggctttctaacccgcaccacttatcgtggtgggga

SEQ ID NO: 4906 - DNA, 112 bp; double-stranded, linear
cgattcggactcaagatagcggattcaggatcagacaggcgaatccagatcagaccagcgactcagacagtgactcagatcagatagtgnctcggattcagcgattattcag

SEQ ID NO: 4907 - DNA, 70 bp; double-stranded, linear
gtaaaaacaccccagccaggtcactttacgcctacgcatcgcttgtacacgtgctactaaaggtttacca

SEQ ID NO: 4908 - DNA, 121 bp; double-stranded, linear
agaagatacaaataaagntaaacccaaattattcaatttcggtgggacacaatagtgttgactttgaagaagatacactttcccaccaagttaagtgggtccataattgaagggtccaacc

SEQ ID NO: 4909 - DNA, 70 bp; double-stranded, linear
gggaacaaagtggacaggtggtgcatggttgtcgtcaactcgtgtcgtgagatgttggggttaagtcccg

SEQ ID NO: 4910 - DNA, 100 bp; double-stranded, linear
ggacacccggagaactgaaacatttagtacccggagaagagaagaaattcgttcccttagtagcgggacgaacgggagagcccaaaccacagcttgtgng

SEQ ID NO: 4911 - DNA, 155 bp; double-stranded, linear
ntctgtgttcggcatgggaacaggtgtgacctccttgctatagtcaccagacaaaataacttacttattcatgatacacgcttaattaataaggtgcaatagttaattttacactttgatgtaaactttggcacatcagcttttagtgtgtttcg

SEQ ID NO: 4912 - DNA, 69 bp; double-stranded, linear
cccgtcacaccacgagatttgtaacacccgaaagccggtggagtgaaccttttaggagctagccgtcga

SEQ ID NO: 4913 - DNA, 69 bp; double-stranded, linear
tatgctctcccagctgagctaattctccgatttaaaactgcctggcaacgttctactctagcggaacgt

SEQ ID NO: 4914 - DNA, 69 bp; double-stranded, linear
caaatgcttctgtcaattcgatcaaatcaatgtcttcaacagatagattgctgagtgacaatacttcat

SEQ ID NO: 4915 - DNA, 70 bp; double-stranded, linear
tatttcggagagaaccagctatttccaggctcgattggaatttctccggtaccctcagttcatccgctca

SEQ ID NO: 4916 - DNA, 67 bp; double-stranded, linear
tcacccattaacgggctctaactacttgtaagcacacggtttcaggttctatttcactccccttccg

SEQ ID NO: 4917 - DNA, 161 bp; double-stranded, linear
tactaagactgtggacgctagaatgagatgccgtgtgatagcgaaaacggtgagaatccctccaccgttgactaaggttccagagaggctcgtccctctgggtagtcgggcctaagctgaggcgcacgtaggcgatgatacaggttatatcctnacaccta

SEQ ID NO: 4918 - DNA, 68 bp; double-stranded, linear
gcacgtagttagccgttggctttctgattaggtaccggcaagatgtgcacagttacttacacatatgt

SEQ ID NO: 4919 - DNA, 78 bp; double-stranded, linear
gaaagcaaatgtcttcgttgcaattcgatcaaatcaatgtcttcaacagatagattgctgagtgacaatacttcaggg

SEQ ID NO: 4920 - DNA, 68 bp; double-stranded, linear
aatttcgctaccttagggaccgttatagttacggccgacgtttactggggcttcgattcgtacttcgc

SEQ ID NO: 4921 - DNA, 67 bp; double-stranded, linear
aatcatagtacctgtaaagatgcaggttacccgcaacaagacggaaagaccccgtggagctttactg

SEQ ID NO: 4922 - DNA, 66 bp; double-stranded, linear
gggagctgtaataagctttgatccagagatttccgaatggggaaacccagcatgagttatgtcatg

SEQ ID NO: 4923 - DNA, 73 bp; double-stranded, linear
gtggaggcgctggtgggatactaccctagctgtgttggctttctaacccgcaaccacttatcgtgggtgggag

SEQ ID NO: 4924 - DNA, 89 bp; double-stranded, linear
gaggtcagcggttcgatcccgctagtctcaccatttattttttacacgatgacatgaaactgatgacatatgcaccgtaattccaaaaa

SEQ ID NO: 4925 - DNA, 68 bp; double-stranded, linear
aatggcatcggagttgtctgaattcggtaacccgagaggcccctcgtccaaacaggctctacctccaa

SEQ ID NO: 4926 - DNA, 73 bp; double-stranded, linear
acgaaaggcgtaacgatttgggcactgatctcgacgagagactcgtgaaaatcatagatacctgtgaagatgc

SEQ ID NO: 4927 - DNA, 69 bp; double-stranded, linear
atttctattaattatttgcatagaaatcagcttttttgatatgtattttataatgtacagctcgttgag

SEQ ID NO: 4928 - DNA, 70 bp; double-stranded, linear
aggtatgtccatcccggtcctctcgtactaaggacatctcctctcaaatttcctacgcccacgacgtata

SEQ ID NO: 4929 - DNA, 83 bp; double-stranded, linear
ggcggggccccaacacagaggctggcggaaagtgcagcttacaatagtgtgcaagttggggtgggtcccgacacagagaaatt

SEQ ID NO: 4930 - DNA, 66 bp; double-stranded, linear
cttggtagagcacttggtttgggaccaaggggtcgcagttcgaatcctgtcttcccgattactcta

SEQ ID NO: 4931 - DNA, 65 bp; double-stranded, linear
aagaagcttgttatgctgcaacaccagcaattcaagtagctaaagattatttagcaactagaccg

SEQ ID NO: 4932 - DNA, 73 bp; double-stranded, linear
tgcagaagaggaaagtggaattccatgtgtagggtgaaatgcgcatagatatggcaggaacaccagtgggcga

SEQ ID NO: 4933 - DNA, 65 bp; double-stranded, linear
tcgctatccgagtctgggtcgctatctgagtctgagtcgctatctgagtctgaaatcgctgtctg

SEQ ID NO: 4934 - DNA, 120 bp; double-stranded, linear
gagcatgtgggtttaattcgaagcaacgcagagaaccttgaccaaatcttggacatccnttgacaactctgagagattagagccttgccccttgcggggtaacaaatgtacaggttggtg

SEQ ID NO: 4935 - DNA, 72 bp; double-stranded, linear
gaaggctcgtccgctctgggttagtcgggtcctaagctgaggccgagcaggtacggcgatggataacggttg

SEQ ID NO: 4936 - DNA, 64 bp; double-stranded, linear
cacatcagcgtcagttacataccagaaagtcgccttcgccactggtgttcctccatatctctgc

SEQ ID NO: 4937 - DNA, 64 bp; double-stranded, linear
atcacctggtgtaaaccaattagtacgtgtatatatcgttcaaaaccgtaaaattcatgttggt

SEQ ID NO: 4938 - DNA, 63 bp; double-stranded, linear
ctgggtagctatgtgtggacgggataagtgctgaaacatctaagcatgaagccccctcaagat

SEQ ID NO: 4939 - DNA, 63 bp; double-stranded, linear
tagaaatcagcttttttgcatatgtattttataatgtacagctcgttgagctgctattttcct

SEQ ID NO: 4940 - DNA, 68 bp; double-stranded, linear
ggtagtcgaacttacgttccgctagagtagaacttgccagcaaatgacaaatcggagaattagctcag

SEQ ID NO: 4941 - DNA, 62 bp; double-stranded, linear
ctgaaacatcttagtacccggagaagagaaagaaaattcgattcccttagtagcggcgagcg

SEQ ID NO: 4942 - DNA, 89 bp; double-stranded, linear
ttacaacaatgcaattggcggggcccaacatagaactggcaatagttactttcaataatgtgcaagttggggtagggcccaacacagaa

SEQ ID NO: 4943 - DNA, 69 bp; double-stranded, linear
aatggacaatatgtcaacgttaattccaaaaaacggtaactataatttacaaacattatttagtattga

SEQ ID NO: 4944 - DNA, 77 bp; double-stranded, linear
cccgtgaaagatgatgaggttaataggtttgaggtggaagcatggtgacatgtggagcgtgacgaatacgtaattga

SEQ ID NO: 4945 - DNA, 75 bp; double-stranded, linear
gaataggtcgatgtatttggcgaccgaaaccaggaatctacccttggtcaggttgaagttcaggtaacactgaat

SEQ ID NO: 4946 - DNA, 135 bp; double-stranded, linear
atcagaaggcacacccgagaatgaaacatctagtacccggagaagagaaagaaattcgattccctatagcggcgncgaaacggaagagccaaccacagctgctttggtttgacccatcggtacagcgctgacact

SEQ ID NO: 4947 - DNA, 61 bp; double-stranded, linear
gatttgggctcttccatttcgctcgccgctactaagggaatcgaatttcctttctcttcct

SEQ ID NO: 4948 - DNA, 70 bp; double-stranded, linear
gcttttgaggaatttaatatcaatatatattctgtgtatgaaaatatttttcataaaaattgtttgaatc

SEQ ID NO: 4949 - DNA, 66 bp; double-stranded, linear
cttcgacctgaccaagggtagatcacctggtttcgggtctacgaccaagtactaaacgccctattc

SEQ ID NO: 4950 - DNA, 78 bp; double-stranded, linear
gggtgttacaaaatatcgtggtgtgacggggcggtgtgtacaagaccccgggtacgtttttcaccgtaggcatgctgg

SEQ ID NO: 4951 - DNA, 61 bp; double-stranded, linear
ccgcgataataaaaaataatggcggaggaagagggattcgaacccccgtggcccgttaagg

SEQ ID NO: 4952 - DNA, 68 bp; double-stranded, linear
acttatctagttttcaatgtacaatgtctttttagtcagcgctcgcataagcaatatcactgtaacca

SEQ ID NO: 4953 - DNA, 59 bp; double-stranded, linear
actgacgctgatgtgcgaaagcgtggggatcaaacaggattagataccctggtagtcca

SEQ ID NO: 4954 - DNA, 60 bp; double-stranded, linear
cgtgagcgctagctgtacgtggaggcgctggtgggatactaccctagctgtgttggcttt

SEQ ID NO: 4955 - DNA, 59 bp; double-stranded, linear
aaggcgtaacgatttgggcactgtctcaacgagagactcggtgaaatcatagtacctgt

SEQ ID NO: 4956 - DNA, 59 bp; double-stranded, linear
aataggtgcccgtaccgcaaaccgacacaggtagtcaagatgagaattctaaggtgagc

SEQ ID NO: 4957 - DNA, 77 bp; double-stranded, linear
acacgtttagttcacgcgggttttgcttggtaaaatctatattttacttacttatctagttttcaatgtacaatttc

SEQ ID NO: 4958 - DNA, 59 bp; double-stranded, linear
tgtcgtcagctcgtgtcgtgagatgttgggttaagtcccgcaacgagcgcaacccttaa

SEQ ID NO: 4959 - DNA, 59 bp; double-stranded, linear
gacttgaacccccaacctactgattacaagtcagttgctctaccaattgagctaggccg

SEQ ID NO: 4960 - DNA, 59 bp; double-stranded, linear
tattaactggtgacttagcgagatggacaacgatggcgatatatttattattgaccgca

SEQ ID NO: 4961 - DNA, 59 bp; double-stranded, linear
atgattatcatattgccttaaatatcgccacaattttagcgggtggtgatttaccaaga

SEQ ID NO: 4962 - DNA, 59 bp; double-stranded, linear
cgccgaaaattgtaccggggctaaacatattaccgaagctgtggattgtcctttggaca

SEQ ID NO: 4963 - DNA, 60 bp; double-stranded, linear
ttaagcttagttgccatcattaagttgggcactctaatgttgactgccggtgacaaaccg

SEQ ID NO: 4964 - DNA, 59 bp; double-stranded, linear
tagttttggtacggtaacaaatttatttgaagaaacaatctcaaataaagaattgtttg

SEQ ID NO: 4965 - DNA, 59 bp; double-stranded, linear
agttcggtccctatccgtcgtggggcgtaggaaattttagaggagctgtccttagtacg

SEQ ID NO: 4966 - DNA, 59 bp; double-stranded, linear
tacaaagggcagcgaaaccgtgagtcaaagcaaatcccataaagttgttctcagttcgg

SEQ ID NO: 4967 - DNA, 65 bp; double-stranded, linear
ccattgcagcaccgacagccacaccatttatttttgcgctatgtatatcgcattaaacgtttgtc

SEQ ID NO: 4968 - DNA, 60 bp; double-stranded, linear
gcctccgttacttttagaggcgacgcccagtcaaactgcccgctgacactgtctcccacc

SEQ ID NO: 4969 - DNA, 59 bp; double-stranded, linear
caaggaatttcgctaccttaggaccgttatagttacggccgccgtttactggggcttcg

SEQ ID NO: 4970 - DNA, 65 bp; double-stranded, linear
catctgtcacaggtactatggatttcaccggagtctctcgttgagacagtgcccaaatcgttacg

SEQ ID NO: 4971 - DNA, 100 bp; double-stranded, linear
ctagagttggcataccagtccgtcgctaaggaacctttcttgacttgatgacaatcgacttgcttctttcctctccttcggctctcacttnctcatttag

SEQ ID NO: 4972 - DNA, 67 bp; double-stranded, linear
agaccccgtggagctttactgtagcctgcatattcgaattcggcacagcttgtacaggataggtagg

SEQ ID NO: 4973 - DNA, 58 bp; double-stranded, linear
tgtgtacttaaaaatatgaatacatgagtaaaactcatgcataagaaatactaatttc

SEQ ID NO: 4974 - DNA, 58 bp; double-stranded, linear
acctccaataatcatcacttgaggctagccctaaagctatttcggagagaaccagcta

SEQ ID NO: 4975 - DNA, 68 bp; double-stranded, linear
gacgccacatccttttccacttggcgtgtgttttgggaccttggctggtggtctgggctgtttcccta

SEQ ID NO: 4976 - DNA, 59 bp; double-stranded, linear
tcactaagtccgtctttcgaccctgactcgacttgtaggtctcgcagtcaagctccctt

SEQ ID NO: 4977 - DNA, 58 bp; double-stranded, linear
taagtaagtaaaatatagattttaccaagcaaaaccgagtgaataaagagttttaaat

SEQ ID NO: 4978 - DNA, 58 bp; double-stranded, linear
gtgaggtacgtccagaatggggattggctaaaaatgcatcatttataattggacgacg

SEQ ID NO: 4979 - DNA, 60 bp; double-stranded, linear
tcgctatctgaatccgaggtcgctatccgaatctggagtcgctatctggagtctggaatc

SEQ ID NO: 4980 - DNA, 58 bp; double-stranded, linear
aagaaggtaataatcctgtagtcgaaaatgttgtctctcttgagtggatcctgagtac

SEQ ID NO: 4981 - DNA, 75 bp; double-stranded, linear
gtggtgtgttagggcactctatacgggttacaaagtacgacattagacggatcatctggaaagatgaatcaaagt

SEQ ID NO: 4982 - DNA, 58 bp; double-stranded, linear
gtttttcattttcatttatatttatattagtgttaatccaatcatagatttatctata

SEQ ID NO: 4983 - DNA, 61 bp; double-stranded, linear
tgacagctaactattggccagcttctatgttggggccccgccaacttgcattgtctgtaga

SEQ ID NO: 4984 - DNA, 64 bp; double-stranded, linear
ggtgtttttaagtctgatgtgaaaacccacggctcaaccggtagaggtcattggaaactggaaa

SEQ ID NO: 4985 - DNA, 59 bp; double-stranded, linear
cagcatacaataatgtgcaagttggtcggggccccaacatagagaatttcaaaagaaat

SEQ ID NO: 4986 - DNA, 57 bp; double-stranded, linear
tgatgaaggtcttcggatcgtaaaactctgttattagggaagaacatatgtgtaagt

SEQ ID NO: 4987 - DNA, 57 bp; double-stranded, linear
aaagaatttgcgcaaaacgctatcgatactgaagggcgttcaatgattatcatgggt

SEQ ID NO: 4988 - DNA, 57 bp; double-stranded, linear
ttgtcacaagtcaagaaaggtctttagcgacgatggtagccaacttacgttccgcta

SEQ ID NO: 4989 - DNA, 57 bp; double-stranded, linear
taggaccgttatagttacggccgccgtttactggggcttcgattcgtagcttcgcag

SEQ ID NO: 4990 - DNA, 61 bp; double-stranded, linear
aaagtcaacgttaattccaaaaaacgtaactataagttactaacattatttagtatttatg

SEQ ID NO: 4991 - DNA, 65 bp; double-stranded, linear
tccacggggtctttccatcctgtctcgggtaacctgcatcttcacaggtactatgatttcaccga

SEQ ID NO: 4992 - DNA, 57 bp; double-stranded, linear
gtgcggctggatcacctcctttctaaggatatattcggaacatcttcttcagaagat

SEQ ID NO: 4993 - DNA, 57 bp; double-stranded, linear
ccaatgcggctcatcgcatccattttttgcctggcaacgttctactctagcggaacg

SEQ ID NO: 4994 - DNA, 57 bp; double-stranded, linear
ctggtttcgggtctacgacaaatactaaacgcctattcagactcgctttcgctacgg

SEQ ID NO: 4995 - DNA, 73 bp; double-stranded, linear
caaactctcgtggtgtgacgggcggtgtggtacaagccccgggaacgtattcaccgtagcatgccggtctacg

SEQ ID NO: 4996 - DNA, 65 bp; double-stranded, linear
actaatttctataggaaaagtattctttatcgtcgtcccaccccaactcgcacattattgtaagc

SEQ ID NO: 4997 - DNA, 58 bp; double-stranded, linear
attggattcccaatttctacagacaatgcagttggggtgggacgtcgaaataaatttt

SEQ ID NO: 4998 - DNA, 56 bp; double-stranded, linear
aacttcaacaggttttgcaggtggcggtgcgactgcaggaagacgttaaattaatg

SEQ ID NO: 4999 - DNA, 56 bp; double-stranded, linear
gggcaggcgtcagccctatacatcaccttacggtttagcagagacctgtgtttttg

SEQ ID NO: 5000 - DNA, 56 bp; double-stranded, linear
ttaggacccgactaacccagagcggacgagccttcctctggaaaccttagtcaatc

SEQ ID NO: 5001 - DNA, 56 bp; double-stranded, linear
gacgggattctcacccgtctttcgctactcacaccggcattctcacttctaagcgc

SEQ ID NO: 5002 - DNA, 56 bp; double-stranded, linear
cctgtcggcctcagcttaggacccgactaacccagagcggacgagccttcctctgg

SEQ ID NO: 5003 - DNA, 56 bp; double-stranded, linear
ttactcatttagctctactaaactcgttgcgctcttttctcgtttcgtcagattca

SEQ ID NO: 5004 - DNA, 57 bp; double-stranded, linear
aatccttgtttcgttttacgtccgagtgcgccattgtcagacaacgtatttacaatt

SEQ ID NO: 5005 - DNA, 57 bp; double-stranded, linear
gacatagattaagttattaagggcgcacggtggatgccttggcactagaagccgatg

SEQ ID NO: 5006 - DNA, 57 bp; double-stranded, linear
ggaaccactacataataaatcattagtggctctttatcattctgtcccactcccctg

SEQ ID NO: 5007 - DNA, 69 bp; double-stranded, linear
cgctacgtttttcctcaacatttaagaaaataaagaatgctacaattacgattgcaatcaaaccaaaga

SEQ ID NO: 5008 - DNA, 57 bp; double-stranded, linear
aaaagcttgttacaagcgctattttcgttcagtcaactactgccaatataacttcgt

SEQ ID NO: 5009 - DNA, 56 bp; double-stranded, linear
acatcttagtacccggagaagagaaagaaaattcgattcccttagtagcggcgagc

SEQ ID NO: 5010 - DNA, 65 bp; double-stranded, linear
gtttggacgaggggccctctcgggttacgattcagacaaactccgatgcaattaatttacttggg

SEQ ID NO: 5011 - DNA, 56 bp; double-stranded, linear
tttacttgtattggaataatttcatctttgaaccgaccatcacgttgtgcgtcata

SEQ ID NO: 5012 - DNA, 60 bp; double-stranded, linear
ccttatacatcacctttacggttttagcagaaacctgtgttttttgataaacagtcgctt

SEQ ID NO: 5013 - DNA, 63 bp; double-stranded, linear
gggcccaacacagaagctggcgaaaagtcagcatacaaaattgtgcaagttggcgggtccaca

SEQ ID NO: 5014 - DNA, 58 bp; double-stranded, linear
tagggtagtatcccaccagtggcctccacgtaagctagcgcttcacgtttcaaaggct

SEQ ID NO: 5015 - DNA, 105 bp; double-stranded, linear
caactccgatgcaattaatttaacttgggancagacatgggtgataaggtcgtgttcgaagggaacagccagacacagctaagtccagatatatgtaagtggaaa

SEQ ID NO: 5016 - DNA, 56 bp; double-stranded, linear
caaacgatttatttatatgcttatttctttatttattattattacaattacatttt

SEQ ID NO: 5017 - DNA, 65 bp; double-stranded, linear
tctgtagaaattggggaatccaatttctcttggtttgggtcccatccccaacttgcacattattg

SEQ ID NO: 5018 - DNA, 56 bp; double-stranded, linear
ggggatgggccccaacaaagagaaattggattcccaatttctacagacaatgcaac

SEQ ID NO: 5019 - DNA, 55 bp; double-stranded, linear
cgattggattgcacgtctaagcagtaaggctgagtattaggcaaatccggtactc

SEQ ID NO: 5020 - DNA, 58 bp; double-stranded, linear
tacggcgtttagtatttggtcgtagccggaaaccaggtgatctacccttggtcaggtt

SEQ ID NO: 5021 - DNA, 55 bp; double-stranded, linear
ttgtgcgggtccccgtcaattcctttgagtttcaaccttgcggtcgtactcccca

SEQ ID NO: 5022 - DNA, 55 bp; double-stranded, linear
agagttcacatcgacggggaggtttggcacctcgatgtcggctcatcgcatcctg

SEQ ID NO: 5023 - DNA, 58 bp; double-stranded, linear
ccttagctggtggtctgggctgtttccctttcgaacacggaccttatcacccatggtc

SEQ ID NO: 5024 - DNA, 55 bp; double-stranded, linear
taaaggctaaactaccaatgttttcaatggatttccaaaatgaatcatctgggat

SEQ ID NO: 5025 - DNA, 63 bp; double-stranded, linear
tcaaaccggaggggtcattggaaactggaaaacttgagtgcagaagaggaaagtggaattcca

SEQ ID NO: 5026 - DNA, 64 bp; double-stranded, linear
gcttgcgtacctaaagagcaccccttctccgaattacggggtcattttgccgagttccttaacg

SEQ ID NO: 5027 - DNA, 56 bp; double-stranded, linear
aatacatagcatatcataaggcacacccggagaactgaaacatcttagtacccgga

SEQ ID NO: 5028 - DNA, 55 bp; double-stranded, linear
gggcccctctcgggttaccaattcagacaaactccgaatgccaattaatttaact

SEQ ID NO: 5029 - DNA, 54 bp; double-stranded, linear
cgtaactataacggtcctaaggtagccgaaattccttgtcgggtaagttccgac

SEQ ID NO: 5030 - DNA, 57 bp; double-stranded, linear
atccccggggccccaacacagagaatttcgaaaagaaattctacaggcaatgcaagt

SEQ ID NO: 5031 - DNA, 54 bp; double-stranded, linear
tgcttggtaaaatctatattttacttacttatctagttttcaatgtacaatttc

SEQ ID NO: 5032 - DNA, 54 bp; double-stranded, linear
tccctatccgtcgtgggcgtaggaaatttgagaggagctgtccttagtacgaga

SEQ ID NO: 5033 - DNA, 54 bp; double-stranded, linear
agaacactcacaagattaataacgcgtttcctgtaggatggaaacatagattaa

SEQ ID NO: 5034 - DNA, 54 bp; double-stranded, linear
tatctgaatctgagtcgctgtctgaatctgaatcgctatccgagtctgagtcgc

SEQ ID NO: 5035 - DNA, 54 bp; double-stranded, linear
caccagcaattcaattagctaaagattatttagcaactagaccggaatgaaaaa

SEQ ID NO: 5036 - DNA, 54 bp; double-stranded, linear
ctaccatcgacgctaagagcttaacttctgtgttcggcatgggaacaggtgtga

SEQ ID NO: 5037 - DNA, 56 bp; double-stranded, linear
cggcgagttacgatttgatgcaaggttaagcagtaaatgtggagccgtagcggaag

SEQ ID NO: 5038 - DNA, 54 bp; double-stranded, linear
gaccgggatggacatacctctggtgtaccagtttgtcgtgccaacgcataagct

SEQ ID NO: 5039 - DNA, 54 bp; double-stranded, linear
tttcaccgagtctctcgttgagcagtgcccaaatcgttacgcctttcgtgcggg

SEQ ID NO: 5040 - DNA, 105 bp; double-stranded, linear
ttataacacgtatgcttggggagtgtaataagcttgatcagagattccnatgggaaccagcatgagttatgtcatttatcatatgtgatcatagcatatcaaagg

SEQ ID NO: 5041 - DNA, 54 bp; double-stranded, linear
ggcacctattttctatctagaggcttttctcggcagtgtggaaatcaacgactc

SEQ ID NO: 5042 - DNA, 54 bp; double-stranded, linear
acttatctagttttcaatgtacaaataatggtggagactagcgggatcgaaccg

SEQ ID NO: 5043 - DNA, 53 bp; double-stranded, linear
cgttcagtcaactactgccaatataacatcgtagagcatagaacattgattta

SEQ ID NO: 5044 - DNA, 59 bp; double-stranded, linear
actagagagtatttagacttaggagtggtcctcccagattccgacggatttcacgtgct

SEQ ID NO: 5045 - DNA, 62 bp; double-stranded, linear
tttcgtcgtcccaccccaacttgcacgctattgtgagctgacttttcgccagcttctgtgtt

SEQ ID NO: 5046 - DNA, 53 bp; double-stranded, linear
cgtcatccccaccttcctccggtttgtcaccggcagtcaacttagagtgccca

SEQ ID NO: 5047 - DNA, 53 bp; double-stranded, linear
tatttattaaacctaataaagatgaattagaagtgatgtttaatacaacagtg

SEQ ID NO: 5048 - DNA, 53 bp; double-stranded, linear
cctcggcaccattttcaataaaaacatatgcgcccgtagctcaattggataga

SEQ ID NO: 5049 - DNA, 59 bp; double-stranded, linear
aaatggccaacttaagccaggatacaatttacaaatagcgacaaattctcaatgtgttt

SEQ ID NO: 5050 - DNA, 111 bp; double-stranded, linear
cgaaagacacncacaagattaataacgcgtttgagtctttttataaagacgtacttcatgttacgttgactttaagatggtggaacatagttagttttagggccacggggg

SEQ ID NO: 5051 - DNA, 53 bp; double-stranded, linear
acgttgacatattgtcattcagttttcaatgttcattaatgttcaatctcttt

SEQ ID NO: 5052 - DNA, 53 bp; double-stranded, linear
ctgaattcggtaacccgagagggcccctcgtccaaacagtgctctacctccaa

SEQ ID NO: 5053 - DNA, 53 bp; double-stranded, linear
tacatagcatatcagaaggcacacccggagaactgaaacatcttagtacccgg

SEQ ID NO: 5054 - DNA, 54 bp; double-stranded, linear
aaatgcggctcatcgcatccattttttgcctggcaacgttctactctagcggac

SEQ ID NO: 5055 - DNA, 53 bp; double-stranded, linear
tagggctagcctcaagtgatgattattggaggtagagcactgtttggacgagg

SEQ ID NO: 5056 - DNA, 63 bp; double-stranded, linear
actgctttgaaatgttgttgtctcagttaatattcaattgcttttcttttgcataattgacaa

SEQ ID NO: 5057 - DNA, 54 bp; double-stranded, linear
ctatgttggggccccgccaacttgcattgtctgtagaattccttttcgaaattc

SEQ ID NO: 5058 - DNA, 53 bp; double-stranded, linear
ctgaatccgagtcgctatccgagtctgagtcgctatctgagtctgaatcgctg

SEQ ID NO: 5059 - DNA, 59 bp; double-stranded, linear
tttgggctacacacgtgctacaatggacaatacaaagggcagcgaaaccgtgatgtcaa

SEQ ID NO: 5060 - DNA, 53 bp; double-stranded, linear
aaataactaataacatttagaggctgggacataaatccctaaaaaacagcagt

SEQ ID NO: 5061 - DNA, 55 bp; double-stranded, linear
ttaaagagtgcgtaatagctcactaatcgagtgacaatggcgccgaaaatgtacc

SEQ ID NO: 5062 - DNA, 52 bp; double-stranded, linear
taccagggtatctaatcctgtttgatccccacgctttcgcacatcagcgtca

SEQ ID NO: 5063 - DNA, 52 bp; double-stranded, linear
tcgccaagccatttttctttgtgtttctttttattttgacgttttagacata

SEQ ID NO: 5064 - DNA, 76 bp; double-stranded, linear
ctcaagctcccttgtgcctttacactctatgtgtgctttccgaccgttctggggggaactttggagcgcctccgtt

SEQ ID NO: 5065 - DNA, 54 bp; double-stranded, linear
ccaccgcttgtgcgggtccccgtcaattcctttgagtcgcaaccttgcggtcgt

SEQ ID NO: 5066 - DNA, 55 bp; double-stranded, linear
tccccgggctaaacatattaccgaagctgtggattgtcctttggacaatggtagg

SEQ ID NO: 5067 - DNA, 52 bp; double-stranded, linear
gctcatcgcatccactttttgcctggcaacgttctactctagcggaacgtaa

SEQ ID NO: 5068 - DNA, 82 bp; double-stranded, linear
cggacaccagaagtaccaagcgagccggaaacaccaacaccaccgacaccagacgtacaagcgagcggaaacaacaacaacg

SEQ ID NO: 5069 - DNA, 52 bp; double-stranded, linear
tccataacgtgctgtatctgtagcaataactaatactttttcattcggtcta

SEQ ID NO: 5070 - DNA, 52 bp; double-stranded, linear
cgactcgaagactcaatgtcttctccccatcacagctcagccttaacgagta

SEQ ID NO: 5071 - DNA, 52 bp; double-stranded, linear
gcgatggataacaggttgatattcctgtaccacctataatcgttttaatcga

SEQ ID NO: 5072 - DNA, 53 bp; double-stranded, linear
cacttcaccacagccgccatggcatgggcagtaggaatcgaacccacaccaaa

SEQ ID NO: 5073 - DNA, 52 bp; double-stranded, linear
gtccagactcctacgggaggcagcagtagggaatcttccgcaatgggcgaaa

SEQ ID NO: 5074 - DNA, 54 bp; double-stranded, linear
tgttggcttagaatcagccatcatttaaagagtgcgtaatagctcactagtcgc

SEQ ID NO: 5075 - DNA, 74 bp; double-stranded, linear
agaattttgaatcccgcgacgatctgccaattccgccacaccggcttaatggtaaacaaaaaacttccctttgg

SEQ ID NO: 5076 - DNA, 53 bp; double-stranded, linear
tgagctaatcagacatcataatttttatggagagtttgatcctggctcaagat

SEQ ID NO: 5077 - DNA, 52 bp; double-stranded, linear
gttaagctccttagcgtcgatggtagtcgaacttacgttccgctagagtaga

SEQ ID NO: 5078 - DNA, 52 bp; double-stranded, linear
gggtaagttccgacccgcacgaaaggcgtaacgatttgggcactgtctcaac

SEQ ID NO: 5079 - DNA, 52 bp; double-stranded, linear
attaatccattgtgccacaagtgccggaccagaaatgatggtatttaataat

SEQ ID NO: 5080 - DNA, 52 bp; double-stranded, linear
aatagcgacgaatcacaccttctgcggcaccacggaataatacaccatgtgg

SEQ ID NO: 5081 - DNA, 52 bp; double-stranded, linear
ctttcgctactcacaccggcattctcacttctaagcgctccacatgtcctta

SEQ ID NO: 5082 - DNA, 56 bp; double-stranded, linear
cagacagcgactcagatcagatagcgatcggactcagacaacgactcagattcaga

SEQ ID NO: 5083 - DNA, 62 bp; double-stranded, linear
agggtatgatccatcccgggtcctctcggtactaagggacagctcctctcaaatttcctacg

SEQ ID NO: 5084 - DNA, 52 bp; double-stranded, linear
gtgtaccagttgtcgtgccaacggcatagctgggtagctatgtgtggacgag

SEQ ID NO: 5085 - DNA, 78 bp; double-stranded, linear
ttgcttacgcttgctatagccaatatatagatgttggagggggcagattcgaatgcgaacccgaggagcggattaaca

SEQ ID NO: 5086 - DNA, 52 bp; double-stranded, linear
actgacgctgatgtgcgaagcgtggggatcacacaggattagataccctggt

SEQ ID NO: 5087 - DNA, 51 bp; double-stranded, linear
aagttgttctcagttcggattgtagtctgcaactcgactacatgaagctgg

SEQ ID NO: 5088 - DNA, 51 bp; double-stranded, linear
aatactttaaaaaaataagacactttggccaacttaagccaggatacaatt

SEQ ID NO: 5089 - DNA, 51 bp; double-stranded, linear
agaacgtaaatttaatcctgatttagcaccagggacagaaaaagtaacaag

SEQ ID NO: 5090 - DNA, 51 bp; double-stranded, linear
ccgctaccctcagttcatccgctcacttttcaacgtaagtcggttcggtcc

SEQ ID NO: 5091 - DNA, 51 bp; double-stranded, linear
catgggtgataaggtccgtgttcgaaagggaaacagcccagaccaccagct

SEQ ID NO: 5092 - DNA, 55 bp; double-stranded, linear
ttgtgcggatccccgtcaattcctttgagtttcaaccttgcggtcgtactcccca

SEQ ID NO: 5093 - DNA, 51 bp; double-stranded, linear
ccgcaaaccgacacaggtagtcaagatgagaattctaaggtgagcgagcga

SEQ ID NO: 5094 - DNA, 51 bp; double-stranded, linear
acgaatactaatcgatcgaagacttaatcaaaataaatgttttgcgacaaa

SEQ ID NO: 5095 - DNA, 77 bp; double-stranded, linear
aatcgttgttaccttcattataccacttacttgtggagtgatcttcttcaaagtaacactattgtgccaccgattga

SEQ ID NO: 5096 - DNA, 52 bp; double-stranded, linear
ttcgtaaggacatgtggagcgcttagaagtgagaatgccggtgtgagtagcg

SEQ ID NO: 5097 - DNA, 51 bp; double-stranded, linear
gggtctgttttctaatttgagcacaatcttcgttctcaatagaatgattta

SEQ ID NO: 5098 - DNA, 51 bp; double-stranded, linear
ctgtagaaattgggaatccaatttctctatgttggggcccacaccccaact

SEQ ID NO: 5099 - DNA, 51 bp; double-stranded, linear
ctgtggattgtcctttggcatgagataggagagcgttctaagggcgttgaa

SEQ ID NO: 5100 - DNA, 51 bp; double-stranded, linear
ggttcagaacgtcgtgagacagttcggtccctatccgtcgtgggcgtagga

SEQ ID NO: 5101 - DNA, 64 bp; double-stranded, linear
tgactgatacgatcaatgcgcttgtaacaagcttttttcaattctagtcaggggccccaacaca

SEQ ID NO: 5102 - DNA, 58 bp; double-stranded, linear
tatttgcatttatattgacgttttaaacataaaaaaagaaaccttgcggtctcaatgg

SEQ ID NO: 5103 - DNA, 50 bp; double-stranded, linear
attaccattttggtataccacatcgttattcaacacattatcttttactt

SEQ ID NO: 5104 - DNA, 53 bp; double-stranded, linear
ggacactgctccctcaggagtctcgccattaatactacgtattaacatgtaat

SEQ ID NO: 5105 - DNA, 50 bp; double-stranded, linear
atttcttctttttctacaatcgagtctccttttacaggtccatattttgt

SEQ ID NO: 5106 - DNA, 50 bp; double-stranded, linear
tggtcaagcggttaagacaccgccctttcacggcggtaacacgggttcga

SEQ ID NO: 5107 - DNA, 50 bp; double-stranded, linear
tttttagcagtaattgccacatctgtgtgacgataatgatatgcgacagt

SEQ ID NO: 5108 - DNA, 50 bp; double-stranded, linear
caagccatttttctttgtgtttactttttattttgacgttttagacataa

SEQ ID NO: 5109 - DNA, 50 bp; double-stranded, linear
agccgatgaaggacgttactaacgacgatatgctttggggagctgtaagt

SEQ ID NO: 5110 - DNA, 53 bp; double-stranded, linear
atccataacgtttggtatctgtagcaataactaatactttttcattcggtcta

SEQ ID NO: 5111 - DNA, 53 bp; double-stranded, linear
cccttagtactgcagctaacgcattaagcactccgcctgaggagtacgacctc

SEQ ID NO: 5112 - DNA, 50 bp; double-stranded, linear
ggagtcaaagtccgttgccttaccgcttggctatagcccaatatatagat

SEQ ID NO: 5113 - DNA, 50 bp; double-stranded, linear
agantttcttttcgaaattctttatgttggggccccgccaacttgcattg

SEQ ID NO: 5114 - DNA, 50 bp; double-stranded, linear
gctgtgatggggagaagacattgtgtcttcgagtcgttgatttcacactg

SEQ ID NO: 5115 - DNA, 55 bp; double-stranded, linear
cttgattaactcattatcaagttatgcacgtgtaaatgaattcggctttatcgaa

SEQ ID NO: 5116 - DNA, 50 bp; double-stranded, linear
gtacttaaaaaatgaatacatgagtaaagctcatggcataagaaatacta

SEQ ID NO: 5117 - DNA, 50 bp; double-stranded, linear
cagaatcagatagcgactcagaatcagatagtgagtcagattcagcagtn

SEQ ID NO: 5118 - DNA, 50 bp; double-stranded, linear
cgaatactaatcgatcgaagacttaatcaaaataaatgttttgcgacnaa

SEQ ID NO: 5119 - DNA, 60 bp; double-stranded, linear
aatcgtcgaaacttaatcaaaataaatgttttgcgacaaatcacttttacttactatcta

SEQ ID NO: 5120 - DNA, 50 bp; double-stranded, linear
ccgaagtttacggggtcattttgccgagttccttaacgagagttcgctcg

SEQ ID NO: 5121 - DNA, 61 bp; double-stranded, linear
ataatcctgtagtcgaaaatgttgtctctcttgagtggatccttagtacgccggggcacgt

SEQ ID NO: 5122 - DNA, 50 bp; double-stranded, linear
tagcgactcagattcagacagcgattcagacagcgactcagactcagata

SEQ ID NO: 5123 - DNA, 50 bp; double-stranded, linear
tatttgtaaattgtatcctggcttaagttggccatttttcatatggtctt

SEQ ID NO: 5124 - DNA, 60 bp; double-stranded, linear
cacgagctgacgacaaccatgcaccacctgtcactttgtcccccgagaaggtctctatct

SEQ ID NO: 5125 - DNA, 64 bp; double-stranded, linear
agaacacattgcagtcttcgagtcgttgatttcacactgccgtagtaaaagcctctagatagaa

SEQ ID NO: 5126 - DNA, 57 bp; double-stranded, linear
ggacgacattagacgaatcatctggaaaagatgagtcaaagaaggtaatagtcctgt

SEQ ID NO: 5127 - DNA, 50 bp; double-stranded, linear
gtccttagtacgagatgaccgggatggacatacctctggtgtaccagttg

SEQ ID NO: 5128 - DNA, 50 bp; double-stranded, linear
gccgattttagcagttgttgcttcgttcaattttatggggccatttatgg

SEQ ID NO: 5129 - DNA, 51 bp; double-stranded, linear
tccacacatagctacccagtctatgccgtttgcactacaactggtacacca

SEQ ID NO: 5130 - DNA, 57 bp; double-stranded, linear
ctcagttggttgagcatctgacttttaatcaaagggtcaagggtcgaatcctctttt

SEQ ID NO: 5131 - DNA, 51 bp; double-stranded, linear
tgatattcacttcaatgttatcaatattagtgccatctatgacatctgcca

SEQ ID NO: 5132 - DNA, 51 bp; double-stranded, linear
tcctgtagtcgaacgtgttgtctctcttgagtggatcctgagtacgacgga

SEQ ID NO: 5133 - DNA, 59 bp; double-stranded, linear
actcagacattggattcagattcagacagcgactcagattcagatagcgactcagattc

SEQ ID NO: 5134 - DNA, 50 bp; double-stranded, linear
ccaccccaacgttgcattgtctgtagaaattgggaatccaatttctcttt

SEQ ID NO: 5135 - DNA, 50 bp; double-stranded, linear
caatacnaagggcagcgaaaccgtgattcaagcaaatcccataaagttgg

SEQ ID NO: 5136 - DNA, 52 bp; double-stranded, linear
gaagctggcgaaaagtcagcttacaaaatgtgccagttggcgggggcccaac

SEQ ID NO: 5137 - DNA, 50 bp; double-stranded, linear
ttgtaaggaagatgctctcccagctgagctaattctccaaaataatgant

SEQ ID NO: 5138 - DNA, 50 bp; double-stranded, linear
ctgtacaagctgtgccgatatttcaatatcangntacagtanagctccac

SEQ ID NO: 5139 - DNA, 52 bp; double-stranded, linear
ggttcgaatcctgtcttcccgatatactgtaattattatgggggctttgctc

SEQ ID NO: 5140 - DNA, 56 bp; double-stranded, linear
gctactgaacctataaaatgtatgatggcggtctcgagggaatcgaacccagatct

SEQ ID NO: 5141 - DNA, 52 bp; double-stranded, linear
aggaggctcgtccgctctaggttagtcgggtcctaagctgaggccgacagta

SEQ ID NO: 5142 - DNA, 56 bp; double-stranded, linear
cacgctttcgacatcagcgtcagttacagaccagaaagtcgccttcgcactggtgt

SEQ ID NO: 5143 - DNA, 75 bp; double-stranded, linear
ctcctaaaacaatttacatccaaaccttcatcactcacgcggcgttgctccgtcagctttcgccattgcgaagat

SEQ ID NO: 5144 - DNA, 55 bp; double-stranded, linear
gaggagtggttagcttctgcggagtacgaatcgagccccgtaaacggcggccggt

SEQ ID NO: 5145 - DNA, 53 bp; double-stranded, linear
gcctaatactcagcctgactgcttagacgtgcaatccatatcagcacgattcg

SEQ ID NO: 5146 - DNA, 51 bp; double-stranded, linear
agctgtggattgtccttttggcatgggtaaggagaacgttctaagggcgtt

SEQ ID NO: 5147 - DNA, 50 bp; double-stranded, linear
ctctttgatccgtagtcaaacgctctatccaattgagctacgggcgcata

SEQ ID NO: 5148 - DNA, 60 bp; double-stranded, linear
gaactaattctccaaaataatgactcctacaggaactcgaacccgtataaccgccgtaaa

SEQ ID NO: 5149 - DNA, 50 bp; double-stranded, linear
aaagcacacccggaaaactgaaacatcttaagtacccggagnaagagaaa

SEQ ID NO: 5150 - DNA, 56 bp; double-stranded, linear
gtaagttcgcactaccatcgacgctaagggagcttaacttctgtggttcggcatgg

SEQ ID NO: 5151 - DNA, 56 bp; double-stranded, linear
ggactacctgtgtcgagtttgcggtaggggtcacctgattttctatctagaggctc

SEQ ID NO: 5152 - DNA, 59 bp; double-stranded, linear
ctattctctgtgtcgggctcaccccaacttgcacactattgtaagctgactttcctcca

SEQ ID NO: 5153 - DNA, 65 bp; double-stranded, linear
taaccacatcattcggatactgttcatggaagtaatttctctattcttcggaccaggaaaataca

SEQ ID NO: 5154 - DNA, 91 bp; double-stranded, linear
ccatatgtgtcagtcactgtgcacatcttgacggtacctaatcagacagccacggctaactccgtgccagccgccgcggtactacgtggtg

SEQ ID NO: 5155 - DNA, 52 bp; double-stranded, linear
gggaaaaggatgtggtcgttgcccagacaactaggatgttggcttataatca

SEQ ID NO: 5156 - DNA, 58 bp; double-stranded, linear
gactctgggaggaccatctcctaaggctaaactactctctcgtgaccgatagtgaacc

SEQ ID NO: 5157 - DNA, 51 bp; double-stranded, linear
ttgtaactccggtataggagtgtcctacaaccccaacaagcaagcttgttg

SEQ ID NO: 5158 - DNA, 50 bp; double-stranded, linear
tagtnaccgntagtgaaccattaccgtgagggaaaggtgaaaagcacccc

SEQ ID NO: 5159 - DNA, 51 bp; double-stranded, linear
ttcgctcgccgctactcaagggaatcgcatttcctttctcttcctccgggt

SEQ ID NO: 5160 - DNA, 61 bp; double-stranded, linear
aactggagaaacaactttatggggtttgcttgaacctcgcggtttcgctgccctttgtatt

SEQ ID NO: 5161 - DNA, 51 bp; double-stranded, linear
agacctctgccttaccacttggctatgcgccaataactgggctacctggat

SEQ ID NO: 5162 - DNA, 55 bp; double-stranded, linear
ccgctcacttttcaacgtaagtcggatcggtcctccattcagtgtcacctgaact

SEQ ID NO: 5163 - DNA, 81 bp; double-stranded, linear
cttgatctgtatttaaaatgatattttctatcttttctttattattaacgtctatgacgtcgtagtataagattccgtgta

SEQ ID NO: 5164 - DNA, 62 bp; double-stranded, linear
gttcgaatcccgtcttctgctccattattttgccggggtggcggcaactctcacacgcacag

SEQ ID NO: 5165 - DNA, 55 bp; double-stranded, linear
caggggtctttcgtcctgtgtgggtaactgcatcttcacaggtactatgatttca

SEQ ID NO: 5166 - DNA, 62 bp; double-stranded, linear
aagctgaggccgacagcgtaggcgatggatgacaggttgatattgccggtaccacccgataa

SEQ ID NO: 5167 - DNA, 52 bp; double-stranded, linear
cttgcgtctccagttccgccaccccggcactataaaaatggagcagaagacg

SEQ ID NO: 5168 - DNA, 56 bp; double-stranded, linear
tcgtccgctatctccaccattatttgtacattgaaactagataagtagtaaatata

SEQ ID NO: 5169 - DNA, 55 bp; double-stranded, linear
cttggacgtcggtgggtagtcgaaacttacgttccgctagagtagaacgttgcca

SEQ ID NO: 5170 - DNA, 52 bp; double-stranded, linear
ctactgctgcatatgcgggtgaagggagtcgaacccccacgccgtaagcata

SEQ ID NO: 5171 - DNA, 50 bp; double-stranded, linear
gggcttnggacattaagttctnaggcaatgtaaaaaagctgatttctatt

SEQ ID NO: 5172 - DNA, 60 bp; double-stranded, linear
aaattacatgttaatacgtaattaatggcgagactcctgaggaaccattgccattcgaag

SEQ ID NO: 5173 - DNA, 50 bp; double-stranded, linear
gttttatttttttaaagtatgtaaaagtaaaattacatgntaatacgtan

SEQ ID NO: 5174 - DNA, 57 bp; double-stranded, linear
caactctcgttaaggaactcggcaaaataccccgtaacttcggagtaggtctcttta

SEQ ID NO: 5175 - DNA, 60 bp; double-stranded, linear
ggaaactggaataaataaacattcaattgagcgcatcagtattaggattcactctaaaaa

SEQ ID NO: 5176 - DNA, 50 bp; double-stranded, linear
gtaacggacgcgctcaaaggttccctcacaatggttggaaatcattcata

SEQ ID NO: 5177 - DNA, 50 bp; double-stranded, linear
agttacgttcttttataaagaggtttgagacgcgttattaatcttgtgag

SEQ ID NO: 5178 - DNA, 53 bp; double-stranded, linear
gtgtggatcctgagtacgacggagcacgtgacaattccgtcggcaatctgggg

SEQ ID NO: 5179 - DNA, 83 bp; double-stranded, linear
cggtaacttcataccttttaacatattttgcatttgattgcgtttaccttttttacctttaccgccaccagtgaactgtttca

SEQ ID NO: 5180 - DNA, 66 bp; double-stranded, linear
ttaaacccttttaattgtttgcccagaacaccatcgctatggatgaaatttaaaaagccgtttaaa

SEQ ID NO: 5181 - DNA, 67 bp; double-stranded, linear
gttcggtaactcgagcgggtctcataacccgtaggtcgggtggttcaaatccgtcctcccgcaatat

SEQ ID NO: 5182 - DNA, 55 bp; double-stranded, linear
tagcggtgaaatgcgcagagatatggaggaacaccagtagcgaaggcaactttct

SEQ ID NO: 5183 - DNA, 50 bp; double-stranded, linear
gaattccatgtgtagcggtgaaatgcgcagagatatgnacgaacaccaat

SEQ ID NO: 5184 - DNA, 62 bp; double-stranded, linear
gaatcagagttggggtgtgggcccgacgaaagagaaattggattcccgaatttctacgagcc

SEQ ID NO: 5185 - DNA, 55 bp; double-stranded, linear
gagaccttgtcggtccatatgcggctcatcgcatccattttttgcctggcaacgt

SEQ ID NO: 5186 - DNA, 50 bp; double-stranded, linear
ccatcattaagttgggcactctaagttgactgccggngncaccnaagaag

SEQ ID NO: 5187 - DNA, 50 bp; double-stranded, linear
ttaatacgttgcaatccaatcgcacgcttcgcctatcctactgccntccc

SEQ ID NO: 5188 - DNA, 50 bp; double-stranded, linear
agtcgctatccgaatctgagtcgctatctgagtctnagtcgctannccag

SEQ ID NO: 5189 - DNA, 54 bp; double-stranded, linear
atagatgcccttaccgcaaaccgacacatgtagtcaatatgataattctaaggt

SEQ ID NO: 5190 - DNA, 50 bp; double-stranded, linear
ctttaatgggcgaacagnacccttggaccgactacagcccagatcgatga

SEQ ID NO: 5191 - DNA, 60 bp; double-stranded, linear
acatagcacccagcgagccgttggacgacaactggtacaccagaggatgccatccggcct

SEQ ID NO: 5192 - protein, 320 aa
MKMINKLIVPVTASALLLGACGASATDSKENTLISSKAGDVTVADTMKKIGKDQIANASFTEMLNKILADKYKNKVNDKKIDEQIEKMQKQYGGKDKFEKALQQQGLTADKYKENLRTAAYHKELLSDKIKISDSEIKEDSKKASHILIKVKSKKSDXEGLDDKEAKQKAEEIQKEVSKDPSKFGEIAKKESMDTGSAKKDGELGYVLKGQTDKDFEKALFKLKDGEVSEVVKSSFGYHIIKADKPTDFNSEKQSLKEKLVDQKVQKNPKLLTDAYKDLLKEYDVDFKDRDIKSVVEDKILNPEKLKQGGAQGGQSGMSQ

SEQ ID NO: 5193 - protein, 330 aa
MNKVIKMLVVTLAFLLVLAGCSGNSNKQSSDNKDKETTSIKHAMGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 5194 - protein, 314 aa
MTRKFRTLILILIATIALSGCANDDGIYSDKGQVFRKILSSDLTSLDTSLITDEISSEVTAQTFEGLYTLGKGDKPVLGVAKAFPEKSKDGKTLKVKLRSDAKWSNGDKVTAQDFVYAWRKTVDPKTGSEFAYIMGDIKNASDISTGKKPVEQLGIKALNDETLQIELEKPVPYINQLLALNTFAPQNEKVAKKYGKNYGTAADRAVYNGPFKVDDWKQEDKTLLSKNQYYWDKKNVKLDKVNYKVIKDLQAGASLYDTESVDDAFITADQVNKYKDNKGLNFVLTTGTFFVKMNEKQYPDFKNKNLRLXSHKQ

SEQ ID NO: 5195 - protein, 280 aa
MKRLIGLVIVALVLLAACGGNNDKKVTIGVASNDTKAWEKVKELAKKDDIDVEIKHFSDYNLPNKALNDGDIDMNAFQHFAFLDQYKKAHKGTKISALSTTVLAPLGIYSDKIKDVKKVKDGAKVVIPNDVSNQARALKLLEAAGLIKLKKDFGLAGTVKDITSNPKHLKITAVDAQQTARALSDVDIAVINNGVATKAGKDPKNDPIFLEKSNSDAVKPYINIVAVNDKDLDNKTYAKIVELYHSKEAQKALQEDVKDGEKPVNLSKDEIKAIETSLAK

SEQ ID NO: 5196 - protein, 273 aa
MKKLFGLILVLTFAVVLAACGNGNKSGSDDKKITVSASPAPHAEILEKAKPLLEKKGYELDIKTINDYTTPNKLLDKGEIDANYFQHTPYLNTEKKDKGYKIVSAGDVHLEPMAVYSKKYKSLKELPKGATVYVSNNPAEQGRFLKFFVDAGLIKIKKGVKIEDAKFSDITENKKDIKFNNKQSAEFLPKIYQNEDADAVIINSNFAIEQKLNPKKDSIAVESAKDNPYANLIAVKEGHQDDKKIKALIEVLQSKDIQDFINEKYNGAVIPAK

SEQ ID NO: 5197 - protein, 313 aa
MKKIKYILVVFVLSLTVLSGCSLPGLGSKSTKNDVKITALSTSESQIISHMLRLLIEHDTHGKIKPTLVNNLGSSTIQHNALINGDANISGVRYNGTDLTGALKEAPIKNPKKAMIATQQGFKKKFDQTFFDSYGFANTYAFMVTKETAKKYHLETVSDLAKHSKDLRLGMDSSWMNRKGDGYEGFKKEYGFDFGTVRPMQIGLVYDALNSEKLDVALGYSTDGRIAAYDLKVLKDDKQFFPPYAASAVATNELLRQHPELKTTINKLTGKISTSEMQRLNYEADGKGKEPAVVAEEFLKKHHYFDKQKGGHK

SEQ ID NO: 5198 - protein, 284 aa
MKKLTTLLLASTLLIAACGNDDSKKDDSKTSKKDDGVKAELKQATKAYDKYTDEQLNEFLKGTEKFVKAIENNDMAQAKALYPKVRMYYERSEPVAEAFGDLDPKIDARLADMKEEKKEKEWSGYHKIEKALYEDKKIDDVTKKDAQQLLKDAKELHAKADTLDITPKLMLQGSVDLLNEVATSKITGEEEIYSHTDLYDFKANVEGAQKIYDLFKPILEKKDKKLSDDIQMNFDKVNQLLDKYKDNNGGYESFEKVSKKDRKAFADAVNALGEPLSKMAVITE

SEQ ID NO: 5199 - protein, 284 aa; identical to SEQ ID NO: 5198

SEQ ID NO: 5200 - protein, 208 aa
MKFKAIVAITLSLSLLTACGANQHKENSSKSNDTNKKTQQTDNTTQSNTEKQMTPQEAEDIVRNDYKARGVNEYQTLNYKTNLERSNEHEYYVEHLVRDAVGTPLKRCAIVNRHNGTIINIFDDMSEKDKEEFEAFKKRSPKYNPGMNNHDETDGESEDIQHHDIDNNKAIQNDIPDQKVDDKNDKNAVNKEEKHDNGANNSEETKVK

SEQ ID NO: 5201 - protein, 184 aa
MLKGCGGCLISFILLIILLSACSMMFSNNDNSTNNQSSKTQLTQKDENKNEDKPEEKSETATDEDLQSTEEVPANENTENNQHEIDEITTKDQSDDDINTPNVAEDKSQDDLKDDLKEKQQSSNHHQSTQPKTSPSTETNTQQSFANCKQLRQVYPNGVTADHPAYRPHLDRDKDKRACEPDKY

SEQ ID NO: 5202 - protein, 208 aa
MKKRLLLSTFLASTLILTGCASDQSDNEDHHTSTGIHAPKSAKKLETKDIFXSDKKNSDISDAEMKQAIEKYLSVNSDILDNKYIMQHKLDKQIDSQTKVTEKQAETLSHLSNLAVKNDLHFKKFVTENNIPKEYKKPVELMMNYFKALNSTIANVDEDIEKLSYQPQNKINVVDVPTKYAGDVNKKQQDKIKDFLKSKGIKSDVIDK

SEQ ID NO: 5203 - protein, 283 aa
MKSKIYILLLXLIFLSACANTRHSESDKNVLTVYSPYQSNLIRPILNEXEKQEHVKIEIKHGSTQVLLSNLHNEDFSERGDVFMGGVLSETIDHPEDFVPYQDTSVTQQLEDYRSNNKYVTSFLLMPTVIVVNSDLQGDIKIRGYQDLLQPILKGKIAYSNPNTTTTGYQHMRAIYSMHHRVSDVHQFQNHAMQLSKTSKVIEDVAKGKYYAGLSYEQDARTWKNKGYPVSIVYPIEGTMLNVDGIALVKNAHPHPKRKKLVQYLTSRSVQQRLVAEFDAKSI

SEQ ID NO: 5204 - protein, 309 aa
MKKFIGSVLATTLILGGCSTMENESKKDTKTETKSVPEEMEASKYVGQGFQPPAEKNAIEFAKKHRKEFEKVGEQFFKDNFGLKVKATNVVGKDDGVEVYVHCEDHGIVFNASLPLYKDAIHQKGSMRSNDNGDDMSMMVGTVLSGFEYRAQKEKYDNLYKFFKENEKKYQYTGFTKEAINKTQNVGYKNEYFYITYSSRSLKEYRKYYEPLIRKNDKEFKEGMERARKEVNYAANTDAVATLFSTKKNFTKDNTVDDVIELSDKLYNLKNKPDKSTITIQIGKPTINTKKAFYDDNRPIEYGVHSKDE

SEQ ID NO: 5205 - protein, 193 aa
MKKLVSIVGATLLLAGCGSQNLAPLEEKTTDLREDNHQLKLDIQELNQQISDSKSKIKGLEKDKENSKKTASNNTKIKLMNVTSTYYDKVAKALKSYNDIEKDVSKNKGDKNVQSKLNQISNDIQSAHTSYKDAIDGLSLSDDDKKTSKNIDKLNSDLNHAFDDIKNGYQNKDKKQLTKGQQALSKLNLNAKS

SEQ ID NO: 5206 - protein, 259 aa
MKRLLFVMIAFVFILAACGNNSSKDKEASKDSKTINVGTEGTYAPFSFHDKDGKLTGYDIDVIKAVAKEEGLKLKFNETSWDSMFAGLDAGRFDVIANQVGINPDREKKYKFSKPYTFSSAVLVIRENEKDIKDFDDVKGKKLAQTFTSNYGKLAKDKGADITKVDGFNQSMDLLLSKRVDGTFNDSLSYLDYKKQKPNAKIKAIKGNAEQSRSAFAFSKKADDETVQKFNDGLKKIEENGELAKIGKKWFGQDVSKSK

SEQ ID NO: 5207 - protein, 203 aa
MGVHSMKLKRLFAVVIAMLLVLAGCSNSNDNNESKKDDADNGKKQEIQVAAAASLTDVTKKLASEFKKEHKNADIKFNYGGSGALRKQIESGAPVDVFMSANTKDVDALKDKNKAHDTYKYAKNSLVLIGDKDSNYTSVKDLKDNDKLALGEVKTVPAGKYAKQYLDNNNLFKEVESXIVYAKDVKQVLNYVXKGNAKQGFVY

SEQ ID NO: 5208 - protein, 327 aa
MKKWQFVGTTALGATLLLGACGGGNGGSGNSDLKGEAKGDGSSTVAPIVEKLNEKWAQDHSDAKISAGQAGTGAGFQKFIAGDIDFADASRPIKDEEKQKLQDKNIKYKEFKIAQDGVTVAVNKENDFVDELDKQQLKAIYSGKAKTWKDVNSKWPDKKINAVSPNSSHGTYDFFENEVMNKEDIKAEKNADTNAIVSSVTKNKEGIGYFGYNFYVQNKDKLKEVKIKDENGKATEPTKKTIQDNSYALSRPLFIYVNEKALKDNKVMSEFIKFVLEDKGKAAEEAGYVAAPEKTYKSQLDDLKAFIDKNQKSDDKKSDDKKSEDKK

SEQ ID NO: 5209 - protein, 324 aa
MKRLSIIVIIGIFIITGCDWQRTSKERSKNAQNQQVIKIGYLPITHSANLMMTKKLLSQYNHPKYKLELVKFNNWPDLMDALNSGRIDGASTLIELAMKSKQKGSNIKAVALGHHEGNVIMGQKGMHLNEFNNNGDDYHFGIPHRYSTHYLLLEELRKQLKIKPGHFSYHEMSPAEMPAALSEHRITGYSVAEPFGALGEKLGKGKTLKHGDDVIPDAYCCVLVLRGELLDQHKDVAQAFVQDYKKSGFKMNDRKQSVDIMTHHFKQSRDVLTQSAAWTSYGDLTIKPSGYQEITTLVKQHHLFNPPAYDDFVEPSLYKEASRS

SEQ ID NO: 5210 - protein, 148 aa
MKKTLGCLLLIMLLVVAGCSFGGNHKLSSKKSEESKQETVKKESEEEKDPDLEKYEEIEKKMKGIKDAPSLDKLDPLMTEKSFTNSKGIQGWKDYKELMGKVELADYRFTKDSKGSSIKDVDAFFKGKKGIKRKVIETHDDVKQVDYW

SEQ ID NO: 5211 - protein, 33 aa
WPCATXQZEWWSRHXWCVCBMVRNLIKDZEELH

SEQ ID NO: 5212 - protein, 490 aa
MSIIMEVATMQAKLTKNEFIEWLKTSEGKQFNVDLWYGFQCFDYANAGWKVLFGLLLKGLGAKDIPFANNFDGLATVYQNTPDFLAQPGDMVVFGSNYGAGYGHVAWVIEATLDYIIVYEQNWLGGGWTDGIEQPGWGWEKVTRRQHAYDFPMWFIRPNFKSETAPRSVQSPTQAPKKETAKPQPKAVELKIIKDVVKGYDLPKRGSNPKGIVIHNDAGSKGATAEAYRNGLVNAPLSRLEAGIAHSYVSGNTVWQALDESQVGWHTANQIGNKYYYGIEVCQSMGADNATFLKNEQATFQECARLLKKWGLPANRNTIRLHNEFTSTSCPHRSSVLHTGFDPVTRGLLPEDKRLQLKDYFIKQIRAYMDGKIPVATVSNESSASSNTVKPVASAWKRNKYGTYYMEESARFTNGNQPITVRKVGPFLSCPVGYQFQPGGYCDYTEVMLQDGHVWVGYTWEGQRYYLPIRTWNGSAPPNQILGDLWGEIS

SEQ ID NO: 5213 - protein, 299 aa
GDKMNKISKYIAIASLSVAVTVSAPQTTNSTAFAKSSAEVQQTQQASIPASQKANLGNQNIMAVAWYQNSAEAKALYLQGYNSAKTQLDKEIKKNKGKHKLAIALDLDETVLDNSPYQGYASIHNKPFPEGWHEWVQAAKAKPVYGAKEFLKYADKKGVDIYYISDRDKEKDLKATQKNLKQQGIPQAKKSHILLKGKDDKSKESRRQMVQKDHKLVMLFGDNLLDFTDPKEATAESREALIEKHKDDFGKKYIIFPNPMYGSWEATIYNNNYKASXKAKDKLRKNAIKQFDPKTGEVK

SEQ ID NO: 5214 - protein, 178 aa
LNKCKIIIWRIINMKNKLIAKSLLTLAAIGITTTTIASTADASEGYGPREKKPVSINHNIVEYNDGTFKYQSRPKFNSTPKYIKFKHDYNILEFNDGTFEYGARPQFNKPAAKTDATIKKEQKLIQAQNLVREFEKTHTVSAHRKAQKAVNLVSFEYKVKKMVLQERIDNVLKQGLVK

SEQ ID NO: 5215 - protein, 173 aa
KERVLMKKLLTASIIACSVVMGVGLVNTSAEAASGNSIDTVKQLIKGDQSLENVKIGESIKDVLTKYKNPMYSYNEDGTEHYYEFHTKKGMLLVTTDGKKNNGKVTHISMMYNDANGPTYQAVKNYVGKAVTHTEYSKVAGNFGYIEKGKTTYQFASAPKDKNIKLYRIDLEK

SEQ ID NO: 5216 - protein, 167 aa
FEVRESMSNQNYDYNKNEDGSKKKMSTTAKVVSIATVLLLLGGLVFAIFAYVDHSNKAKERMLNEQKQEQKEKRQKENAEKERKKKQQEEKEQNELDSQANQYQQLPQQNQYQYVPPQQQAPTKQRPAKEENDDKASKDESKDKDDKASQDKSDDNQKKTDDNKQPA

SEQ ID NO: 5217 - protein, 115 aa
MKRNFPKLIALSLIFSLSVTPIANAESNSNIKAKDKKHVQVNVEDKSVPTDVRNLAQKDYLSYVTSLDKIYNKEKASYTLGEPFKIYKFNKKSDGNYYFPVLNTEGNIDYIVTIS

SEQ ID NO: 5218 - protein, 173 aa
NFKMQEVKYMTEITFKGGPIHLKGQQINEGDFAPDFTVLDNDLNQVTLADYAGKKKLISVVPSIDTGVCDQQTRKFNSDASKEEGIVLTISADLPFAQKRWCASAGLDNVITLSDHRDLSFGENYGVVMEELRLLARAVFVLDADNKVVYKEIVSEGTDFPDFDAALAAYKNI

SEQ ID NO: 5219 - protein, 139 aa
IESRFIMAKINFDAATKGNPGISTCAIVIKEDEQHYTYTHELGEMDNHTAEWAACIYALEHARELNVQNALLYTDSKLIADSIEAGYVKNANFKPYFDQIEIFEKDFDLLFVKWIPREQNKEANQHAQQALYKLIKKNK

SEQ ID NO: 5220 - protein, 162 aa
MPGTVLDPQMIKNEDVSEKEYAAVSQQLSKLPGVNTSMDWDRKYPYGDTLRGIFGDVSTPAEGIPKELTEHYLSKGYSRNDRVGKSYLEYQYEDVLRGKKKEMKYTTDKSGKVTSSEVLXPGARGQDLKLTIDIDLQKEVEALLDKQIKKLAVKVPKIWIMQ

SEQ ID NO: 5221 - protein, 311 aa
IMAYDGLFTKKMVESLQFLTTGRVHKINQPDNDTILMVVRQNRQNHQLLLSIHPNFSRLQLTTKKYDNPFNPPMFARVFRKHLEGGIIESIKQIGNDRRIEIDIKSKDEIGDTIYRTVILEIMGKHSNLILVDENRKIIEGFKHLTPNTNHYRTVMPGFNYEAPPTQHKINPYDITGAEVLKYIDFNAGNIAKQLLNQFEGFSPLITNEIVSRRQFMTSSTLPEAFDEVMAETKLPPTPIFHKNHETGKEDFYFIKLNQFNDDTVTYDSLNDLLDRFYDARGERERVKQRANDLVRFVQQQLHKYQNKLAS

SEQ ID NO: 5222 - protein, 245 aa
ISELIEEYEQSKNKDTEQLYGELITANIYRIKQGDKEVTALNYYTNEEVVIPLNPTKSPSANAQYYYKQYXRMKTRXRELQHQIQLTKDNIDYFSTIEQQLHHISVHDIDEIRDELAEQGFMKQRKNQTKKKKAQIQLQHYVSTDGDDIYVGKNNKQNDYLTNKKAKKTHTWLHTKDIPGSHVVIFNDAPSDTTIKEAAMLAGYFSKAGNSGQIPVDYTLIKNVHKPSGAKPGFVTYDNQKTLYA

SEQ ID NO: 5223 - protein, 99 aa
YITNPQNPKIKITGISLSSGVGNFFIITNGKRIIVAKIKRNADNDSALKSFNAIFIIGNADPHNMIVNKYDRKVVSRSLFINIITPLIMCFYIKKYDLK

SEQ ID NO: 5224 - protein, 131 aa
ENVLAKEYAVKYNAVEAIQHRGETVTEGSSSNAYAIKDGVIYTHPINNYILNGITRIVIKKIAEDYNIPFKEETFTVDFLKNADEVIVSSTSAEVTPVIKLDGEPVNDGKVGPITRQLQEGFEKYIESHSI

SEQ ID NO: 5225 - protein, 540 aa
NHLTARIINQEDDLMNLFRQQKFSIRKFNVGIFSALIATVTFISTNPTTASAAEQNQPAQNQPAQPADANTQPNANAGAQANPTAQPAAPANQGQPAVQPANQGGQANPAGGAAQPNTQPAGQGDQADPNNAAQAQPGNQATPANQAGQGNNQATPNNNATPANQTQPANAPAAAQPAAPVAANAQTQDPNASNTGEGSINTTLTFDDPAISTDENRQDPTVTVTDKVNGYSLINNGKIGFVNSELRRSDMFDKNNPQNYQAKGNVAALGRVNANDSTDHGNFNGISKTVNVKPDSELIINFTTMQTNSKQGATNLVIKDAKKNTELATVNVAKTGTAHLFKVPTDADRLDLQFIPDNTAVADASRITTNKDGYKYYSFIDNVGLFSGSHLYVKNRDLAPKATNNKEYTINTEIGNNGNFGASLKADQFKYEVTLPQGVTYVNNSLTTTFPNGNEDSTVLKNMTVNYDQNANKVTFTSQGVTTARGTHTKEVLFPDKSLKLSYKVNVANIDTPKNIDFNEKLTYRTASDVVINNAQPEVH

SEQ ID NO: 5226 - protein, 177 aa
YKELSHGRLIGGTKMHKKYFIGTSILIAVFVVIFDQVTKYIIATTMKIGDSFEVIPHFLNITSHRNNGAAWGILSGKMTFFFIITIIILIALVYFFIKDAQYNLFMQVAISLLFAGALGNFIDRILTGEVVDFIDTNIFGYDFPIFNIADSSLTIGVILIIIALLKDTSNKKEKEVK

SEQ ID NO: 5227 - protein, 209 aa
AGKSSLIKSLIGEFNATGTKLLYNKPIQQQLQHITYIPQKAHIDLDFPISVEQVILSGCYKEIGWFRRPNKSARDKLKQLLSDLELESLRHRQISELSGGQLQRVLVARALMSXSEVYFLDEPFVGIDFSSEKLIMTKIENLKQQGKLILIIHHDLSKAKQYFDRIILLNQTLRYFGDSEEAMSVTRLNETFMSSTDCSDPSQRSNITC

SEQ ID NO: 5228 - protein, 256 aa
TFRIIFLLSIRKRSNRTHVSIHWSTVNKEEICLRVKDNLQQISTQINDKSEKNNFSTKPNVIAVTKYVTIERAKEAYEAGIRHFGENRLEGFFQKKEALPSDAVIHFIGSLQSRKVKDVINDVDYFHALDRLSLAKEINKRAEHKIKCFLQVNVSGEASKHGIALEDVDQFIDDLKKYDKIEIVGLMTMAPLTDDEAYIRSLFKQLRLKKEEIQRLNLEYAPCDELSMGMSNDYLIAVEEGATFVRIGTKLVGEEE

SEQ ID NO: 5229 - protein, 246 aa
KHKLTIITGGFFTMKKTIMASSLAVALGVTGYAAGTGHQAHAAEVNVDQAHLVDLAHNHQDQLNAAPIKDGAYDIHFVKDGFQYNFTSNGTTWSWSYEAANGQTAGFSNVAGADYTTSYNQGSNVQSVSYNAQSSNSNVEAVSAPTYHNYSTSTTSSSVRLSNGNTAGATGSSAAQIMAQRTGVSASTWAAIIARESNGQVNAYNPSGASGLFQTMPGWGPTNTVDQQINAAVKAYKAQGLGAWGF

SEQ ID NO: 5230 - protein, 519 aa
KEPHKMKKIYKSLTVSAIVATVSLSALPQSLAITHESQPTKQQRTVLFDRSHGQTAGAADWVSDGAFSDYADSIQKQGYDVKAIDGHSNITEASLKSSKIFVIPEANIPFKESEQAAIVKYVKQGGNVVFISDHYNADRNLNRIDSSEAMNGYRRGAYEDMSKGMNAEEKSSTAMQGVKSSDWLSTNFGVRFRYNALGDLNTSNIVSSKESFGITEGVKSVSMHAGSTLAITNPEKAKGIVYTPEQLPAKSKWSHAVDQGIYNGGGKAEGPYVAISKVGKGKAAFIGDSSLVEDSSPKYVREDNGEKKKTYDGFKEQDNGKLLNNITAWMSKDNDGKSLKASSLTLDTKTKLLDFERPERSTEPEKEPWSQPPSGYKWYDPTTFKAGSYGSEKGADPQPNTPDDHTPPNQNEKVTFDIPQNVSVNEPFEMTIHLKGFEANQTLENLRVGIYKEGGRQIGQFSSKDNDYNPPGYSTLPTVKADENGNVTIKVNAKVLESMEGSKIRLKLGDKTLITTDFK

SEQ ID NO: 5231 - protein, 316 aa
RDERIKTMTNSSKSFTKFMAASAVFTMGFLSVPTAGAEQTNQIANKPQAIQWHTNLTNERFTTIAHRGASGYAPEHTFQAYDKSHNELKASYIEIDLQRTKDGHLVAMHDETVNRTTNGHGKVEDYTLDELKQLDAGSWFNKKYPKYARASYKNAKVPTLDEILERYGPNANYYIETKSPDVYPGMEEQLLASLKKHHLLNNNKLKNGHVMIQSFSDESLKKIHRQNKHVPLVKLVDKGELQQFNDQRLKEIRSYAIGLGPDYTDLTEQNTHHLKDLGFIVHPYTVNEKADMLRLNKYGVDGVFTNFADKYKEVIK

SEQ ID NO: 5232 - protein, 433 aa
RFMKNLISIIIILCLTLSIMTPYAQATNSDVTPVQAANQYGYAGLSAAYEPTSAVNVSQTGQLLYQYNIDTKWNPASMTKLMTMYLTLEAVNKGQLSLDDTVTMTNKEYIMSTLPELSNTKLYPGQVWTIADLLQITVSNSSNAAALILAKKVSKNTSDFVDLMNNKAKAIGMKNTHFVNPTGAENSRLRTFAPTKYKDQERTVTTARDYAILDLHVIKETPKILDFTKQLAPTTHAVTYYTFNFSLEGAKMSLPGTDGLKTGSSDTANYNHTITTKRGKFRINQVIMGAGDYKNLGGEKQRNMMGNALMERSFDQYKYVKILSKGEQRINGKKYYVENDLYDVLPSDFSKKDYKLVVEDGKVHADYPREFINKDYGPPTVEVHQPIIQKANTVAKSMWEEHPLFTIIGGTCLVAGLALIVHMIINRLFRKRK

SEQ ID NO: 5233 - protein, 151 aa
LTKEREYMKLKSFITVTLALGMIATTGATVAGNEVSAAEKDKLPATQKAKEMQNVPYTIAVDGIMAFNQSYLNLPKDSQLSYLDLGNKVKALLYDERGVTPEKIRNAKSAVYTITWKDGSKKEVDLKKDSYTANLFDSNSIKQIDINVKTK

SEQ ID NO: 5234 - protein, 497 aa
NHCNRIERKMAMSNNFKDDFEKNRQSIDTNSHQDHTEDVEKDQSELEHQDTIENTEQQFPPRNAQRRKRRRDLATNHNKQVHNESQTSEDNVQNEAGTIDDRQVESSHSTESQEPSHQDSTPQHEEEYYNKNAFAMDKSHPEPIEDNDKHDTIKNAENNTEHSTVSDKSEAEQSQQPKPYFTTGANQSETSKNEHDNDSVKQDQDEPKEHHNGKKAAAIGAGTAGVAGAAGAMAASKAKKHSNDAQNKSNSGKANNSTEDKASQDKSKDHHNGKKGAAIGAGTAGLAGGAASKSASAASKPHASNNASQNHDEHDNHDRDKERKKGGMAKVLLPLIAAVLIIGALAIFGGMALNNHNNGTKENKIANTNKNNADESKDKDTSKDASKDKSKSTDSDKSKEDQDKATKDESDNDQNNANQANNQAQNNQNQQQANQNQQQQQQRQGGGQRHTVNGQENLYRIAIQYYGSGSPENVEKIRRANGLSGNNIRNGQQIVIP

SEQ ID NO: 5235 - protein, 886 aa
LLSIKYNLIGVVNNMNKHHPKLRSFYSIRKSTLGVASVIVSTLFLITSQHQAQAAENTNTSDKISENQNNNATTTQPPKDTNQTQPATQPANTAKNYPAADESLKDAIKDPALENKEHDIGPREQVNFQLLDKNNETQYYHFFSIKDPADVYYTKKKAEVELDINTASTWKKFEVYENNQKLPVRLVSYSPVPEDHAYIRFPVSDGTQELKIVSSTQIDDGEETNYDYTKLVFAKPIYNDPSLVKSDTNDAVVTNDQSSSVASNQTNTNTSNQNISTINNANNQPQATTNMSQPAQPKSSTNADQASSQPAHETNSNGNTNDKTNESSNQSDVNQQYPPADESLQDAIKNPAIIDKEHTADNWRPIDFQMKNDKGERQFYHYASTVEPATVIFTKTGPIIELGLKTASTWKKFEVYEGDKKLPVELVSYDSDKDYAYIRFPVSNGTREVKIVSSIEYGENIHEDYDYTLMVFAQPITNNPDDYVDEETYNLQKLLAPYHKAKTLERQVYELEKLQEKLPEKYKAEYKKKLDQTRVELADQVKSAVTEFENVTPTNDQLTDLQEAHFVVFESEENSESVMDGFVEHPFYTATLNGQKYVVMKTKDDSYWKDLIVEGKRVTTVSKDPKNNSRTLIFPYIPDKAVYNAIVKVVVANIGYEGQYHVRIINQDINTKDDDTSQNNTSEPLNVQTGQEGKVADTDVAENSSTATNPKDASDKADVIEPESDVVKDADNNIDKDVQHDVDHLSDMSDNNHFDKYDLKEMDTQIAKDTDRNVDKDADNSVGMSSNVDTDKDSNKNKDKVIQLNHIADKNNHTGKAAKLDVVKQNYNNTDKVTDKKTTEHLPSDIHKTVDKTVKTKEKAGTPSKENKLSQSKMLTKNWRNNXQAN

SEQ ID NO: 5236 - protein, 236 aa
NMNKNVMVKGLTALTILTSLGFAENISNQXHSIAKAEKNVKEITDATKEPYNSVVAFVGGTGVVVGKNTIVTNKHIAKSNDIFKNRVSAHHSSKGKGGGNYDVKDIVEYPGKEDLAIVHVHETSTEGLNFNKNVSYTKFADGAKVKDRISVIGYPKGAQTKYKMFESTGTINHISGTFMEFDAYAQPGNSGSPVLNSKHXLIGILYAGSGKDESEKNFGVYFTPQLXXFIPNNIEK

SEQ ID NO: 5237 - protein, 363 aa
YRLEHTIMKMRTIAKTSLALGLLTTGAITVTTQSVKAEKIQSTKVDKVPTLKAERLAMINITAGANSATTQAANTRQERTPKLEKAPNTNEEKTSASKIEKISQPKQEEQKTLNISATPAPKQEQSQTTTESTTPKTKVTTPPSTNTPQPMQSTKSDTPQSPTIKQAQTDMTPKYEDLRAYYTKPSFEFEKQFGFMLKPWTTVRFMNVIPNRFIYKIALVGKDEKKYKDGPYDNIDVFIVLEDNKYQLKKYSVGGITKTNSKKVNHKVELSITKKDNQGMISRDVSEYMITKEEISLKELDFKLRKQLIEKHNLYGNMGSGTIVIKMKNGGKYTFELHKKLQEHRMADVIDGTNIDNIEVNIK

SEQ ID NO: 5238 - protein, 150 aa
FMKFKSLITTTLALGVLASTGANFNNNEASAAAKPLDKSSSSLHHGYSKVHVPYAITVNGTSQNILSSLTFNKNQNISYKDLEDRVKSVLKSDRGISDIDLRLSKQAKYTVYFKNGTKKVIDLKAGIYTADLINTSEIKAININVDTKKQ

SEQ ID NO: 5239 - protein, 239 aa
EKRFMQMARKVVVVDDEKPIADILEFNLKKEGYDVYCAYDGNDAVDLIYEEEPDIVLLDIMLPGRDGMEVCREVRKKYEMPIIMLTAKDSEIDKVLGLELGADDYVTKPFSTRELIARVKANLRRHYSQPAQDTGNVTNEITIKDIVIYPDAYSIKKRGEDIELTHREFELFHYLSKHMGQVMTREHLLQTVWGYDYFGDVRTVDVTIRRLREKIEDDPSHPEYIVTRRGVGYFLQQHE

SEQ ID NO: 5240 - protein, 133 aa
XLSTVIGAXLFFKSSVSLVFKMVKKFRXGVISVNDVMFSSSIMYRIKKNAFSLTVMAIISAITVSVLCFAAISRASLSSEIKYTAPHDVTIKDQQKANQLASELNNQKIPHFYNYKEVIHTKLYKDNLFDVKA

SEQ ID NO: 5241 - protein, 508 aa
EIYIIANKQRRDNMAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGNPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 5242 - protein, 540 aa; identical to SEQ ID NO: 5225

SEQ ID NO: 5243 - protein, 274 aa
ITLKTVSQLIDMKQKQTKISMVTAYDFPSAKQVEAAGIDMILVGDSLGMTVLGYESTVQVTLADMIHHGRAVRRGAPNTFVVVDMPIGAVGISMTQDLNHALKLYQETNANAIKAEGAHITPFIEKATAIGIPVVAHLGLTPQSVGVMGYKLQGATKEAAEQLILDAKNVEQAGAVALVLEAIPNDLAEEISKHLTIPVIGIGAGKGTDGQVLVYHDMLNYGVEHKAKFVKQFADFSVGVDGLKQYDQEVKSGAFPSEEYTYKKKIMNEVNNND

SEQ ID NO: 5244 - protein, 430 aa
SDDWPKSITSLSIRGVRMKHQETTSQQYNFSIIKHGDISTPQGFTAGGMHIGLRANKKDFGWIYSSSLASAAAVYTLNQFKAAPLIVTEDTLQKSKGKLQALVVNSANANSCTGQQGIDDARQTQTWVAQQLQIPSEHVAVASTGVIGEYLPMDKIKTGTEHIKDANFATPGAFNEAILTTDTCTKHIAVSLKIDGKTVTIGGSTKGSGMIHPNMATMLAFITTDASIESNTLHQLLKSSTDHTFNMITVDGDTSTNDMVLVMANHQVEHQILSQDHPQWETFVDAFNFVCTFLAKAIARDGEGATKLISVNVSGAKSISDARKIGKTIVSSNLVKSAIFGEDANFGRIITAIGYSGCEIDPNCTYVQLNQIPVVDKGMAVLFDEQAMSNTLTHENVTIDVQLGLGNAAATAYGCDLSYDYVRINASYRT

SEQ ID NO: 5245 - protein, 469 aa
NPALTVFAFIMIISILLAYVFKWLGLVDDVLLMVIIISTISLGVVVPTLKEMNIMRTTIGQFILLVAVLADLVTMILLTVYGAINGQGGSTIWLIGILVVFTAISYILGVQFKRMSFLQKLMDGTTQIGIRAVFALIILLVALAEGVGAENILGAFLAGVVVSLLNPDEEMVEKLDSFGYGFFIPIFFIMXGVDLNIPSLIKEPKLLIIIPILIVAFIISKLIPVMFIRRWFDMKTTIASAFLLTSTLSLVIAAAKISERLNAISAETSGILILSAVITCVFVPIIFKKLFPVPDEFNRKIEVSLIGKNQLTIPIAQNLTSQLYDVTLYYRKDLSDRRQLSDDITMIEIADYEQDVLERLGLFDRDIVVCATNDDDINRKVAKLAKAHQVERVICRLESTTDDTELVDSGIEIFSSYLSNKILLKGLIETPNMLNLLSNVETSLYEIQMLNYKYENIQLRNFPFGGDII

SEQ ID NO: 5246 - protein, 414 aa
AIIVILLFLRNIRTTAISIISIPLSLLMALIALKLSDVSLNILTLGALTVAIGRVIDDSIVVVENIYRRLTDSEEQLKGENLIISATTEVFKPIMSSTLVTIIVFLPLVFVSGSVGEMFRPFALAIAFSLLASLLVSITLVPALAATLFKKGVKRRNKQHQEGLGVVSTTYKKVLHWSLNHKWIVIILSTLILVATIVFGGPRLGTSFISAGDDKFLAITYTPKPGETEQAVLNHAKDVEKYLKQKKHVKTIQYSVGGSSPVDPTGSTNSMAIMVEYDNDTPNFDVEADKVIKHADGFKHPGEWKNQDLGTGAGNKSVEVTVKGPSMDAIKSTVKDIEQKMKQVKGLANVKSDLSQTYDQYEIKVDQNKAAENGISASQLAMHLNENLPEKTVTTVKENGKTVDVKVKQNKQTA

SEQ ID NO: 5247 - protein, 555 aa
GKPFIIGLGDIIVKKLTTILFQYKIFPVLMFLVSTGLGIIVITQNILIADFLAKIIRHQFQGLWIVLFILLGVLLLRATVQFLNQWLGDTLAFKVKHMLRQRVIYKNNGHPIGEQMTILTENIDGLAPFYKSYLPQVFKSMMVPLIIIIAMFFIHFNTALIMLITAPFIPLFYIIFGLKTRDESKDQMTYLNQFSQRFLNIAKGLVTLKLFNRTEQTEKHIYDDSTQFRTLTMRILRSAFLSGLMLEFISMLGIGLVALEATLSLVVFHNIDFKTAAIAIILAPEFYNAIKDLGQAFHTGKQSEGASDVVFEFLEQPNYNNEFLLKYEENQKPFIQLTDISFRYDDSDRLVLNDLNLEIFKGDQIALVGPSGAGKSTLTHLIAGVYQPTIGTISTNQRDLNIGILSQQPYIFSASIKENITMFKDIENNTIEEVLDEVGLLDKVQSFTKGINTIIGEGGEMLSGGQMRRIELCRLLVMKPDLVIFDEPATGLDIQTEHMIQNVLFQHFKDTTMIVIAHRDNTIRHLQRRLYIENGRLIADDRNISVNITENGDDL

SEQ ID NO: 5248 - protein, 393 aa
VWKLKMRWIKRKKKNFLNSKFNFNNGKIATYLYKERTAMWNKNRLTQMLSIEYPIIQAGMAGSTTPKLVASVSNSGGLGTIGAGYFNTQQLEDEIDYVRQLTSNSFGVNVFVPSQQSYTSSQIENMNAWLKPYRRALHLEEPVVKITEEQQFKCHIDTIIKKQVPVCCFTFGIPSEQIISRLKAANVKLIGTATSVDEAIANEKAGMDAIVAQGSEAGGHRGSFLKPKNQLPMVGTISLVPQIVDVVSIPVIAAGGIMDGRGVLASIVLGAEGVQMGTAFLTSQDSNASELLRDAIINSKETDTVITKAFSGKLARGINNRFIEEMSQYEGDIPDYPIQNELTSSIRKAAANIGDKELIHMWSGQSPRLATTHPANTIMSNIINQINQIMQYK

SEQ ID NO: 5249 - protein, 936 aa
NDFLKRGNKMNMKKKEKHAIRKKSIGVASVLVGTLIGFGLLSSKEADASENSVTQSDSASNESKSNDSSSVSAAPKTDDTNVSDTKTSSNTNNGETSVAQNPAQQETTQSSSTNATTEETPVTGEATTTTTNQANTPATTQSSNTNAEELVNQTSNETTSNDTNTVSSVNSPQNSTNAENVSTTQDTSTEATPSNNESAPQSTDASNKDVVNQAVNTSAPRMRAFSLAAVAADAPVAGTDITNQLTNVTVGIDSGTTVYPHQAGYVKLNYGFSVPNSAVKGDTFKITVPKELNLNGVTSTAKVPPIMAGDQVLANGVIDSDGNVIYTFTDYVNTKDDVKATLTMPAYIDPENVKKTGNVTLATGIGSTTANKTVLVDYEKYGKFYNLSIKGTIDQIDKTNNTYRQTIYVNPSGDNVIAPVLTGNLKPNTDSNALIDQQNTSIKVYKVDNAADLSESYFVNPENFEDVTNSVNITFPNPNQYKVEFNTPDDQITTPYIVVVNGHIDPNSKGDLALRSTLYGYNSNIIWRSMSWDNEVAFNNGSGSGDGIDKPVVPEQPDEPGEIEPIPEDSDSDPGSDSGSDSNSDSGSDSGSDSTSDSGSDSASDSDSASDSDSASDSDSASDSDSASDSDSDNDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSASDSDSDSDSDSDSDSDSDSDSDSDSDSDSDSDSDSDSDSESDSDSDSDSDSDSDSDSDSDSDSASDSDSGSDSDSSSDSDSESDSNSDSESVSNNNVVPPNSPKNGTNASNKNEAKDSKEPLPDTGSEDEANTSLIWGLLASIGSLLLFRRKKENKDKK

SEQ ID NO: 5250 - protein, 194 aa
VSKLKKEILEWIISIAVAFVILFIVGKFIVTPYTIKGESMDPTLKDGERVAVNIVGYKTGGLEKGNVVVFHANKNDDYVKRVIGVPGDKVEYKNDTLYVNGKKQDEPYLNYNLKHKQGDYITGTFQVKDLPNANPKSNVIPKGKYLVLGDNREVSKDSRAFGLIDEDQIVGKVSFQVLAHFSEFQTSISXLKIL

SEQ ID NO: 5251 - protein, 559 aa
LKAXYAKLDDVSKFEDVTDNMSLDFDTNGGYSLNFNNLDQSKNYVIKYEGYYDSNASNLEFQTHLFGYYNYYYTSNLTWKNGVAFYSNNAQGDGKDKLKEPIIEHSTPIELEFKSEPPVEKHELTGTIEESNDSKPIDFEYHTAVEGAEGHAEGTIETEEDSIHVDFEESTHENSKHHADVVEYEEDTNPGGGQVTTESNLVEFDEDSTKGIVTGAVSDHTTIEDTKEYTTESNLIELVDELPEEHGQAQGPIEEITENNHHISHSGLGTENGHGNYGVIEEIEENSHVDIKSELGYEGGQNSGNQSFEEDTEEDKPKYEQGGNIVDIDFDSVPQIHGQNNGNQSFEEDTEKDKPKYEQGGNIIDIDFDSVPHIHGFNKHTEIIEEDTNKDKPNYQFGGHNSVDFEEDTLPQVSGHNEGQQTIEEDTTPPIVPPTPPTPEVPSEPETPTPPTPEVPSEPETPTPPTPEVPTEPGKPIPPAKEEPKKPSKPVEQGKVVTPVIEINEKVKAVVPTKKAQSKKSELPETGGEESTNNGMLFGGLFSILGLALLRRNKKNHKA

SEQ ID NO: 5252 - protein, 251 aa
TKNEKINDVTAVAEKEVVEETKATGTDVTNKVEVEEGSEIVGHKQDTNVVNPHNAERVTLKYKWKFGEGIKAGDYFDFTLSDNVETHGISTLRKVPEIKSTDGQVMATGEIIGERKVRYTFKEYVQEKKDLTAELSLNLFIDPTTVTQKGNQNVEVKLGETTVSKIFNIQYLGGVRDNWGVTANGRIDTLNKVDGKFSHFAYMKPNNQSLSSVTVTGQVTKGNKPGVNNPTVKVYKHIGSDDLAESXXCKA

SEQ ID NO: 5253 - protein, 163 aa
ILHLRENIIVKSNLRYGIRKHKLGAASVFLGTMIVVGMGQEKEAAASEQNNTTVEESGSSATESKASETQTTTNNVNTIDETQSYSATSTEQPSQSTQVTTEEAPKTVQAPKVETSRVDLPSEKVADKETTGTQVDIAQPSNVSEIKPRMKRSMTLQQLQRKK

SEQ ID NO: 5254 - protein, 1027 aa
ILHLKGDIIVKNNLRYGIRKHKLGAASVFLGTMIVVGMGQDKEAAASEQKTTTVEENGNSATDNKTSETQTTATNVNHIEETQSYNATVTEQPSNATQVTTEEAPKAVQAPQTAQPANIETVKEEVVKEEAKPQVKETTQSQDNSGDQRQVDLTPKKATQNQVAETQVEVAQPRTASESKPRVTRSADVAEAKEASNAKVETGTDVTSKVTVEIGSIEGHNNTNKVEPHAGQRAVLKYKLKFENGLHQGDYFDFTLSNNVNTHGVSTARKVPEIKNGSVVMATGEVLEGGKIRYTFTNDIEDKVDVTAELEINLFIDPKTVQTNGNQTITSTLNEEQTSKELDVKYKDGIGNYYANLNGSIETFNKANNRFSHVAFIKPNNGKTTSVTVTGTLMKGSNQNGNQPKVRIFEYLGNNEDIAKSVYANTTDTSKFKEVTSNMSGNLNLQNNGSYSLNIENLDKTYVVHYDGEYLNGTDEVDFRTQMVGHPEQLYKYYYDRGYTLTWDNGLVLYSNKANGNEKNGPIIQNNKFEYKEDTIKETLTGQYDKNLVTTVEEEYDSSTLDIDYHTAIDGGGGYVDGYIETIEETDSSAIDIDYHTAVDSEAGHVGGYTESSEESNPIDFEESTHENSKHHADVVEYEEDTNPGGGQVTTESNLVEFDEESTKGIVTGAVSDHTTVEDTKEYTTESNLIELVDELPEEHGQAQGPVEEITKNNHHISHSGLGTENGHGNYDVIEEIEENSHVDIKSELGYEGGQNSGNQSFEEDTEEDKPKYEQGGNIVDIDFDSVPQIHGQNKGNQSFEEDTEKDKPKYEHGGNIIDIDFDSVPHIHGFNKHTEIIEEDTNKDKPSYQFGGHNSVDFEEDTLPKVSGQNEGQQTIEEDTTPPIVPPTPPTPEVPSEPETPTPPTPEVPSEPETPTPPTPEVPSEPETPTPPTPEVPAEPGKPVPPAKEEPKKPSKPVEQGKVVTPVIEINEKVKAVAPTKKPQSKKSELPETGGEESTNKGMLFGGLFSILGLALLRRNKKNHKA

SEQ ID NO: 5255 - protein, 155 aa
GEKCMFLAWNEIRRNKLKFGLIIGVLTMISYLLFLLSGLANGLINMNKEGIDKWQADAIVLNKDANQTVQQSVFNKKDIENKYKKQATLKQTGEIVSNGHQKDNVLVFGVEKSSFLVPSLIEGHKATKDNEVLADETLKNKGLKLGDTLSLSXXR
